United States Patent 12,648,973 (ACTIVE SUBSTANCE OF Lactobacillus plantarum GKM3, A COMPOSITION COMPRISING THEREOF AND ITS USE FOR PROMOTING LONGEVITY) - sequence listing, part 2

SEQ ID NO: 1 - DNA, 3137761 bp, Lactobacillus plantarum (residues 1,568,882-3,137,761 of 3,137,761)
acaacttgctgcaaattatacaattttattagccgtggtattgaaaaagcccatcaccctggtaaattattcaccaaacttttgatctagcgcatgtccaacaaacatatgaggccatggcgaattattgttcgtagtctgcaataattgttgacactaaattgactggcacaatcagcttcaataaatacgcttaattttaggactaatggtctgaaattaacaatttgtcaagctacaattctgactaataatcgcccaaaaacagttgaaagctaggctagttgccgctaattaccggggcttcatacaaccgcagtactcaaggatgccactcacatttatggtgtttagcaagcggcctctaatataaattacggtagactgacgtggttgccgacaagataaattagtattacagactggtctaaattacacatctttaccatttttgaacgtgactgatgattcggttaagcgcgtgattgaatactgtcatgatacggtttttggcgtttccggtccatggcaaatcatgtcttttgaaaaaataaggctgtcgttagcaaaccatcgattcaataaattggcttgagaaacaattacgttctaaaagcaatttttaaacccaaggtgcacagcaattcagtcgattgactaacagttatgagcaataacatcattaacacagtcaaaagctatttcatgatgcatggtggccaccttatgaatcataatcatatattcacggtaagtcacatcaatatgattcagtgagttcagtagattttataaaaatgtgccataaattaatttgccacccaaaaattatcgctgtgctagcagtaaacttgatgacaattcacgcgataaaaggggtttgttgtgattatgatggcttatgtgtggattatgggtaaatctagctagggggctttttttacattttttagtttacataatatatattatacaaagtagaatcaaaaaaattgctcccccacgacctgatttaggtcccctgtggtaattttttgattttaagttagctttctggtgattcagttctcagattgtcattttgtcgcaatcattttgctggctctaactgttcagaatttttcaagacgtccgcttaacttaaattattttttatgattcacaaacatcaacactaaaattagtcgattgaatttcaaccgagcattttcgttaatttggatcaacttatctgaatcactaaaagttcaaatgttttcagactcctaaatccaattatcactagtttgcatgcacgctcatgatttgctgataactaacatcgattttacggtttatttaagggacaacttcttcaactaataaacgaacacgcgcttagaacgcgtctctcagcatcggtcaaatcgcttgtttttgttgtaaatttatgttttagttaaagtaagaattctaacccagaaaggatgtcctactatcaatgaccgctaaatttccgtatgctaaaagctttctcgcctcattagaaactgctggcaagcaagctagtacgattgagcaatatgaattaaccttggctgactttttcaactatgagcagcacttcaatgaaacctttgctaaggatcaattattaacagatttaactgagaatgatattcaagcttacttggccatgctccgtgaacaacgccaattcaaaacatcgacactgaacaaatgtctgtcgaatctaaacggctactttagctatttattttcacaccgaattattacaactttaccaacctttacaatcaaagggcaacccttgaccaatcgtcaacaaacaacgacctggccagagcaattggcggcatggttagcaatggatgatctgcatccatacacccgcttattcttgttactaacgaccaagggttatactgccacggagatgctaaccccagggttttatcagcagttgaatgcaattacctttacagcagtagaacaggcttttctggttaaactacgggcctatttgcagccattacagactcaaagtggtagttcggacctttttttaaagcagcgtcaacgcggaaccgacccacatatcaccctcgcggcattgcataaatacttggcgggtgatagtcaacgtttaggtgtgccattaaagccggttgcattgcgccaggacttcatgctgtggtttctcaatcaacaccggacgaccgaaccgactgagatcatgcaacaactacggttagatgaaaccagcctcgaatattaccaaaacttgctacgacaacgtgatttgcgaactttaaaagccactaaaaccgactaagtgacactgatgggctaactgctacagttagcttttttagttaaagtaactttacgttgttgcacgatctttacataactttacaaacacgtcacaagcattacgtggaatttgctagttaattaagaagccttaaaacgcctatacaacgcacctttttgcagttaaactagttttattgaatttaactaaagtattgaaaggatgatttgatgacattctatcgttggttagaaccgtttattgaacaaaatggtccgttcgcgccagccgcttgttatgcgcactcagattttgattttcctttgactagtaatgttcatgaattatctgattatattacttacttaaatattcgtgactcagtcaaaaaatcattttattcagcattggacgcgtaccaagcaagttaacaatcataattgaactcaaaaaccaacctactagcccagcgacgattgctgtggttgcaggttggtttattcgtgtttttagccttatttttatcgagatgagactcaaacgatacgaagatcgcaaatctgagccattttcaacgcttaatcaccatctagcttattgccaatgttgcttaataaacgcctcacgaccacccatttcttcgatttgataacggaatggattgcgtcgataaaagtcttggtgctcggcttctgcgggataaaatggcttcgcatctgcaatggttgtcacaatcggctcagcaaacttaccgctagctgcaagtgcatctcttgaagcagttgcagttcgacgttgagcttcactattaacaaaaattactggtcgataactgtcaccacggtcctgaaattggccagaagcatcggttggatcagtctgacgccagtaaatttcgaccaagtcagcataactgattacatctgggtcaaaagtgattttaaccgcttcagtatgcccagtcgtgtggctggcaacttgttcatacgtcggattagcgacggtaccaccagtgtaacctgaaatgactgacttgatcccgggctgttgatcaaacggtttgaccatgcaccagaaacagccaccagcaaatattgcagtctctgtcatctaaattcctcccgtttattaactcaattatttaaataaactctgatactgaccataaccagccttttcaaggtcggcaactggaatgaacttcagtgctgctgaattaatacaataacgaagcccgccacgatctcgtggcccatctggaaagacgtgacctaaatgtgagtttgcttgtgtgctagtcacttctgttcgatgcatgccaaacgactcgtcacggtgttcgttaagattagtctgatcgattggtttagtgaaggatggccacccacaacccgcatcatatttgtcacgcgagctaaagagtgcttgaccactaactacatcaacgtaaataccttcctggtaaaagttatcatactcaccgctaaatggccgttcggtcgctgcctcttgagtaacggcgtattgttcaggcgttagacgctgtcgtaattcaccttgctgtttatccattactatcagtccttccataattgagttgtgtacaatctaattacagtatttatcataccccaatctatctagaatgcaaaaaagaagctccaacaagtggtagcttctttttaaattaatctgtaaattaagcgttgaaggcgtccgttaattgagggacaacttgcttcttacgtgaaacgacacctggtaagcttaaccggttgttagcaatcgtcttaccaaaggctttttcaacaggttccgttgggttaccaacgactaataattccgagttactatctaagatattagtagccaagattaagaataaatcatagccgtcactcgcattttcgtcttttgcagcagcttctaaagcagcttgacgcttgaaaacatcatccaagtcaactgtgttgatttgcgcaacgcgcacggtcttgccagccatttcaaatgacttcgcatcggcatcgattaattccttttcagtcttgctgtcaaggttagtgcccgctttaagcattgctaaaccatacgtttcataatcaatatcagcaattttagctaagtctttaacaactgccacgtcagtttccgttgtggttggggactttaagagtaatgtatctgaaatgattgcagataacattaatccagctaacttggctggaatttcaatgtcattttctttgaacaacttgtaaataacagtgctgcagcaaccaagtggttcagcccggtagaataatggttgggccgtgtcaaaaccagcaattcgatgatgatcaaccacgtgactaacagttacgtcagcaatgtcactcacactttgttgaggttcgttatgatcaacaagcataacactgtcaacttcatcactggccttagtaatcacccgtagtgctggttcatcgaagtaatccaaaacaaattgagtttcttcgtttggttcgcctaatgcaactgcttcagtgtccgctcccatcttattttcgtagtatgagaacgccttagccgccacgattgcgtcggtatcaggattttgatgtccaaaaactaattccttactcattagcacaaaactcccttaaaacttatttttgattaatcttttgtaaccgtgaaatataatcttcggtccgtaagtaggcatcaaattcatcaaggaaattcttgattcgcggaatttggtccttatctttacggaagacaaaatttaagtcaaacttgatggctggttcaaatgacaacgtgtggagcttatcagttgccggattagccaccataaatgaatttggcaacgccgtgttagtattagttgctgccacaaagcgataaatctgttgtggcgtcgtaaaccgtgcgactgccgttggcaaatcagccaactggttcttataagattccttaaccacttgatccaagtaatagttttcaggatacgtcacccatggattgagcgtcgtatctttgaacttgatgcgcttcttcttcgctaacttctcgtcacccgaaatgaatagcaattcgtcttggataatcttcttagactggtatggcttccagttcttgatactttcatcaggtaggtacatgactgccaaatcaatccgattattttctaatcgttcccaaatctctttacgcgtcagcatgtgcaacgaaataataacatttggattggcctcgtaatacttaatggcaaaatcctcaaatacatggtcttcaattgaagctagcacgccaatattgattgttccttgagtagcactagttgtctgctggatttcatcagttgccttgttcaatacactataaatactgtgggttgcgttaagcattgtgtaaccggcgtcagagagacgtaactttttcccaacggaataaaataaaggggcaccaacggtacgctctagttttttgatctgttgggtcaatgctggttgcgtaattcctaaaatttgagctgcttgtgtgtaattcatagtttcagctagttgcaagaaatacgttaacgttttcgatgagaaaatactttcttgagttgtcttcatgaattttactgatcctttcttcttatcgccatcttatgatatctataattttatacaagattcaaagtgaaagcaagcggttgttattggtaaataaagcttaactaattcataatcttttaccctgttatcatattatcttaatcgaatgcccgttaacgtgcaagtattcgcattggaaactataccgttagtgggatcggatggatctgcatagaaacaggttccccttcagtatcagtatcaactacaaaagagccattagaataacgcgcactagtaggatgatcatcattcaagatcgaatggtgcttaccacgatcagtcagcacatcaagtgcaaccccatttgcgtcactagcaactaagacataatcagcgacccggtgtggattattttttaactcccgtaagacttgaacgccccgccgtgcacgacttgtcacgggtaaatctgccaccttcatcttcttgaatgaaccccgttgcgtaatcatggcaatcaaatcatcatctgcggcgattgttgcccgtacaatggcatcgtcgcgcagatccatagatttcacgccgaccgccttcgcaccaatcgttgggacctcgcttaaatcatagcgaaggccatacccatgttgcgttatcagaatcagggttcccgttggtgcagctggtaagtattcgactgttacaacggttgcatcgtctgacttcattttgatgaactggctggcccgagtcttataagttcgacccggcgtgtaatcagcaaaggccgtttgtttgatatagccgtcactagttgccactaagaattttccggtagctttaaggttctcaaaagaatagacccacgtgatgcgctcgttttcagccagcccaatcgtctgagaaatgtgctcaccggtatctttccatttggcgtcagcaatttcataaatcggccggtaaatgagatggcccatgttggtgaacatcattaaatgatctaacgtgctatttttagctagatagatcggataatcctcatctttaagcccgttatcatcaggctcagacgctgaataagagcgtaagctggttcgcttgatatagccatcatggctaatcatgacaatgacgtcttcttgtggaatcacgacctcggtcttgacctttaattcttgaatttcattttgaatctcagtcaaacggctcgttggataggctttttgaacggcccttagttcgcgccgtaaaactttatcgagttctttaggctctgccagaatcagctgataggttgcgatagccttggccagttcagctgattctttttctagctgcgtcacatcggtattggttaaccgataaagttgcattgtcacgatggcttcagcttgaatctcagagaaatcgaattgactgaccaagttctgtttggcgcccttcttatccttgctaccacgaatcgttttaattacttggtcgaggatggacatcgccttgattaatccttgaacgatgtgttggcgatccatagccttctgtaagttaaattgggtccgacgggttacaacgtcccgttgatgttccaagtaggccgttagaatcgttttcagcccaacgtgttcgggccgttgatgataaatggcgaccatattgaagttataagtaatttgtagatcggtatttttgagtaagtaagtcagaataccttctgcattgacgtcacgcttcagttcaatcaccactgataatccctgacggtcactttcatcacgaacttcggcgataccttcgatcttcttcagaatgcgaatttcatcaatttttttcaccaattgcgccttgttaacttcataagggatctctgaaacttcaatctgtgatttattccccttaagcggtacgatcttggttcgcgaacgcacgacgatacgcccacggccagtttcataggcttgcttgatacctgctaagccttgaatgatccccccagttggaaaatcggggcccttgacaaagtccatcaaattttcaagcgttgccttagggtgattcatcaggaataaaatcgcatcaatgacttcactcaagttatgcggcggaatttccgttgcataaccggctgaaatccccgttgccccgttaactaataagttcggaaaacgggccggtaaaacagttggttcgtactccgtatcatcaaaatttaggaccatatcgacagtctttttatcaatgtcttgaagcatttcaccagcgattttactcaaacgtgcctcagtataccgcatggcggcagccggatcaccgtccatggaaccattattcccgtgcatttcaatcagcggttcccgtaacttccagtcctgactaagacgaaccattgcttcataaatcgaagaatcaccatggggatgaaaattacccatgacatttccgactgatttagcggacttacggaacgctttgtcaaaggtgttgccatcctgattcatggcgtataagattcgtcgttgtactggcttcaagccatcacggatgtctggcaaggcccgttcttgaataatatatttagaataacggccgaagcggtcgcccatgacgtcttcaagggttagttcttgaatttttggttgttcagttgccattttacgaccccctctattgttttagctgttgtgccaattcttcgtcggcttgctcatgtgcggatgagacggcctcgttatctagtaacgacccgtcttcgtccaaattaaagtggacgttactttcgatccattttcgacgaggttcaactttgtcccccattaacgttgtgacccgtttttctgctaaggcagcgtcatcgattcgaactcggactaaggtccgtttttcaggatccatggttgtttcccatagctgttccgcgttcatttcgccaagtcccttgtagcgctggagtgcatagcccttaccaaatgacttggtcttgagcgttaactcttcgtcagtccatgcatattccgtccgtaactgcttgttctgctttttttgtaatcgatacagcggtggcaacgcaatgtagattttaccagcgtcaatcattggccgcatgtacttataaaagaatgtcagtaagagaatttgaatatgggcaccatcggtatcggcatcggtcataataatgatcttgtcataattactggccttaatatcaaattcaggaccaacacccgcaccaattgtgtaaatcatggtattgatttcttcattcttgacaatatcagctaatttggccttttcggtattcaacaccttaccacgtaatggcaaaattgcttggaactttcgatcacgcccctgtttagctgaaccaccggccgaatccccttcgactaagaataattcattcttcttagcgtttttagactgcgctggcgttaattttccagaaagtaaccgttcctgcttatgacgccgcttaccgtttcggctttcatcacgggccttacgggcagcctcacgagcctgccgagctttggtggatttgcgaatcagcatttgagcaaattcaccattttccatcaagaagaattgaagttgttcactcacaatattatcaacaatcgttcgtgcttcgggtgttccgagcttttccttagtttgaccttcaaattgtaagagattttccggtactcgtaatgaaataacagcggataacccttcacggacatcggagccttccaaatttttatccttgtccttcaataggccaaccttgcgagcatattcattgaacgctttcgtccaggcactgcggaaccctacttcatgagtcccaccgtctggcgttcgcacgttattgacgaatgacaacaagttttccgaatagccatcgttgtactgcgcagcgacctcaacttcgacaccttccttagtgccgtcaaagaacataatatccccgagggtgtccttatcttcattgaggtaactgacaaacgccttgataccatcttcgtaatggaagaccagctcttgttgttgattttcccgttcgtcagtcagcgtgattttaacgcctttcagtaagaatgcggattcacgcaaccgttcagccaacgtttgaaaattataaaccgtcgttgtaaagatactagcgtccggcttaaaagtcattgtcgttccagttggcttattagtcttccctttcttttcaagggtaccgacgggatgccccccatctttgaaatgttcaacgtagcggtagccatcacggacgatggttaccgtcaattcggacgacaatgcgttaacgacgctcgcaccaaccccatgcagcccaccagaagtcttataaccaccctggccgaacttaccaccagcatgcaaaaccgtgaggataacttcaggtgttggaataccagaagcatgcattccaactggcatcccacgaccatgatcgacaacggtgatgctgttatcggcgtgaataatcacgttgatttctttaccatagccagctaaggcttcatcaacagcattatcgacaatttcataaactaagtgatggagtccgcggccgtccgtagaaccgatatacattccgggacgtttccgaacggcttctaatccttcaagtacttggattgaagaatcatcatattttgggcttttcttggccattctcacaactccttttatctttaaaaatctacctcaactaggtgcggctttcaggtaaccgtaataaaatagtcctaaaagccccaacctgtcaaggtacaattatgttaatttctaattgtcacttgtggctcttcatctgttagcatacacgttaacaattaaaatagcaaacacacgttcgcgtttaaaactatcttttaaaaattaagccacttactagcttacctcatgttgattctaagcgccagttcaatgaataaacttattactggtcacgactagttcttaaaatgcgtgattaatttgacagttagcgctttaaaggccctaaccacccgcttttaggcacataataattatcaaaaaatcattttattttcataatttgacacgcaatcatcattttttaaactaattaatccccacaatcttaaaaagaatgctaaaatattgagtgattctattgcaggaggaaccaactttgaaaataataattatgctgatcatcgcctacttaattggcgcgattccttcgggtgtcattattggcaagtttttctttcacactgatattcgtcaagcaggtagcggtaatatcggaactaccaacacgtaccgggtcctaggcccgaccgctgggacaattgtcatggtgatggatattctaaaaggcaccatcgcagcactacaaccgaccttgctatttcatatgaataaccggtataccttattgattggactagcagctattttaggacatactttctcaatttacatcggctttaaaggtggtaaggccgttgccacgagtgctgggatcttattggcctacaactgggagttcttcttaattgctagtgccatcatgttattattggtttacacgaccagtatggtcagtgttgctagtatgacggcttttccaatcgtcactttgattgcaatcttttactatcaggattggttgctatcactcgtggcctttgcattgaccctcttcatcttctatcggcaccgcagtaatattgcacgtatcaaaaacgggaccgaatcattggtacacttcggacttggttggcgacgtcagcaacgggctaaccgcaaataattatgttactttcaagaccatttcattactgagtggtctttttatttaggaacgggtaaactttggtgctgggtttgtatttttttgtttatagttaaagtaagatgatacaattttttattttgctatcttttcagaccacaataaaaaaccggtcaaacctgtcgaccggtttcactaaaccacagtattttagttagaaaaagctaatcgcatatttagcatcaaacgtctggttcgctgcaagccgattaatgcccatcttatggcttaattgaccatcgctatcaacgttatccgcaatgccccaccatggctctaagcacacgaacggcgcttctgcggggtatggtgaccacatgccgacgtatggtgcatcttcaatcgtcatcgctaccccatgatcatccagatcagtgtccaacattaacgtcgtctcgtgatgatccaaatccaaaatcagggcatcgtccttaaacaaatcccggctaagtgctaatggcttggtcaggtcgaagtcatccgcatttgccgcatcgttcaacggtgcctgtaatggaatatgcgcgtagacctttcgtggtgccacggtaaccttataatcagctagtgtgcccgccggatcagcgagtggtacgttaaatgctgggtgcccaccaacagaaaataacagctcttgattagctggattatgcacattgtagttaacggtcaattcatgatccgtcaacgtataaatcaaacgtaatcgaaacgcgtacggatacatctcccgcgtcgcacgactatcggtcaattcaaatgttgcttgtgtggccgtttggttgacgaccgtaaagtcattgtcgcgggcaaaaccgtgttgtcccatgtgataagcctgaccagcaacagtatactggtcatcctttaaacgaccaatgattggaaaaagcacgggtgcgtgccggccccaaaaagttttgtcggcctgccacatgtactcaataccgtcactcgacttgacactacttaattccgccccagcttcattaatcaaaacggtgaggtactcattctttaattcgactgtcatccgcgtaaacgcccccttaataaattttataagatgtaacgactaagatccttatcctgtgcaatgttaccgattcgctcgttgacatagctttcagtgattgtgacttcgcccatttccatgtcaggaccttcgtatagcaattcttccaagagcttttccaaaatggtgtgcaaacgacgggcaccgatattttgtgtctcatggttgaccttataggcaatcgtggcaatcgcttcgatagcttcaatcgtgaacgtcactttaatgttgtccgtaccgatcaaagcgatatactgcttaatcaacgcattcttaggttccgtcaaaatcttaacaaagtcatccttgcttaaatcgtctaattcgacccgaattggaaaacggccttgcaattcagcaatcagatcactaggtttactttccgcaaaggccccggaagcgataaacagaatgtgatcagtattgatgggaccatattttgttgaaatttgtgacccctcaacgattggcagaatatctcgttgaaccccttcacgtgaaacttcaccggaaccttgctgaccacccttagtaatcttatcaatttcatcgataaaaataatcccggtattttcagcacggacaatcgcatcatgataaatatcagcgttattgactaacttttcggattcttcccggactaaaatttctcgggcctctgagactggcattgtccgttggatccgcttcttgggcattaaggcacctaaactatcaccaagatcaatacccatttgaccaagcatgttattattacccgcggcggcttgttgggggtcatccatctcgatggtaacctctgagttttctaagcgccccgttttcaactgatcggcaactgataatcgttgattacgaacttcatcggtcacttcttcgttacttgaatcgtcaacgttgggggtctggccgttttgcatctggctaaacatgttcatcatgttttggaactcgttaccattattcttagcctgcttcttttgggctggtactaataatttgacgagccgtttatcagcagcctgcaccgcttgcgcccgcacaccagaataagcctgttgtttttccatctcgatagccacgtccactaagtcacgaaccatggattcgacatcgcgaccaacatagccgacttccgtaaatttagttgcttcaaccttcacaaacggggcgtgcacaatcttagccaaccgccgggcaatttcggtcttcccgaccccggttggtccgatcatcagcatatttttgggggtaatttcttcctgcatttcagcagaaagttccatccgccgataacgattacgtagcgcgattgccaccgcttttttagcttggttttgaccaataacataattatcaagcgcggccacaatttgtttcggtgtcttattgatttcttccatgagcgtttcctcctacattacaacgtttctgagatcacattatgattggtaaagatatcaatgtcgccggcaatatggattgccgcttcagcgacttccttggcactcatatccttggcatgcagctgcattgcgcgagctgcggctaaggcaaaattaccaccagaaccaatggctaagacgtcgttatccggcgtgattacttcaccactcccagaaacaagtaacatgtcatctttgttcatgacgatcaacaaagcttccaatttctgtaacgcctggtcactgcgccattcctgggcaagctcaacggctgcccgttgtaaattaccagaaaattcgttgagtttcttttcaaaacgatcttcaaggttaaacgcatccgcgacactcccggcaaaacctacgacgacctgatcattataaatccgccgaactttatgggctgtccctttcattacgactttttcacccatcgtgacctgaccatcaccggccatggcgttatggccgttttggcgaacggcgcaaatggtagttgcttcaaatttcgttgtcatgttcagtctcctttgtcgattcccgcgttgcccgtgggaaaaattgacgataatcttgttgtaaatgttcctttgtcacgtgcgcataaatttgcgtcgttgacaaacttgtatgacctaacagctcctgcacggtccgtaaatcggcaccattattcagcatctgcgttgcaaacgtgtgccggagcatgtggggatgaatatcagccgttaaactacttttcttaacgatttgattcaagacatattcgattccgccgccagtaatggggccgccgtgacgattaataaacaccgtttggtgcgtttgaccatacttggccatcacgggctgccggcagacggtttcgtaatgctgaagcgcggtagccgcgtaccgaccaaatgggacgtaacgttccttgtcgcccttcccacgaatcaacatcatttttaggtcgtaatcaacgtcggctaattgtagatcgacacactcactcagccgaatcccagtaccatacaggacttctaataacgccgcgttccgggcccccatcacgctatcatccgcatagacggtttgaaataatacgtccagctccttttgatagaaaaaacggggtaagcgcgccgcgtgttttttgagttggacgtacacgaagggattcaatttagctaaatcattcttaaccaaaaagttatagaacgaccgcaagcttgaaactttccgagcaattgaattgcgggtcaagtgccggtcatataaatgacttaaatagacgttaacgtccaaccggtcaacttcagtatacgctttcgcgccgccatttgccgttaagaaatcattaaaagcttgaatgtcttcccgataagcagcagcggtctcttccgaatactgtcgttcaacccgaatatactttaaaaagagggttaaataatccgtttccatgcaaaaacctccatacgttgctactttagcaaagtatggaggaaaacacaattatgcaccctgtcaatggggcgatattttagttgttaacggtcaatgtttcatctttaaaagtcgtcaggtcagccaaggcccgttcagaaatcgccgtattacgttcacgcttatcccgaatgcgctgtttgagttttggcataatgccaaagttggcgttcatgggctggaagttgctagcgctcgtatgcgtgatatagtgggccatcgcccccatcatcgtgtccgttggaaaaacgaccggttctaaaccaagtgctaagcgcgctgcgttggttccagcaacgatgccactcgctgcactttcaatatagccttcgacgcccgtcatttggcccgcaaaaaacaaatcgggccgttgctgtgtctgataagttggcgttaatagtttcggtgacttcataaaagtattacgatgcatgacgccataacggacaaattcaacgttctccagacccggaatcagtgaaaagacccgtttttgttcgccccacttaagatgagtttggaaaccgacgatattatatagatcaccagcggcatcatcttggcgcaactgaacgaccgcaaagggttgtttgcccgtcttcggatcttcaaggcccactggtttaagtgggccaaatagcatcgtttggcgcccacgttgtgccatcacttcgatcggcatgcagccttcaaagacatctgaattttcaaaatcatgcgcttcggccatttcggcgtgaatcaacgcgtcatagaaaacgtcaaattcggcttccgtcattgggcagttcagataggccgcttcaccacggtcatagcgtgatttgagatacaccttatccatgtcgatcgaatctttcgttagaatcggtgcggccgcatcaaaaaagtgtaagtcatcttcgtcgttaaacgcttgaatcgatttcgctaaggacgccgccgttaatggtccagtcgctacgaccgtaatgccatctgggagactagtaatttcttcattaataatttcaacattaggtaacgcggtgattgcagccgtgatttctgcagagaacgtatcccgatcaacggctagcgcaccgccagctgggacagcgtggtgttcagccgcttgcatcacgatcgaatccatctgccgcatttcggcctttagtaggcccgccgcgttggctaattggttcgcccgcagtgagtttgtgcacactaattcagcaaattgcgccgtgtgatgggcgggggtcattttgctgggccgcatttcatacagccggacattgacgcccatattagcaatatgccaagcggcctctgagccggctaaaccggcgccaattacgtttactgttggtattgatgccatccagaattcctcttttcttgttgtcataccattgatagtattgttgtcatcatacctgagaaactaacagaagacaactaatggcatcagcaaatcctgcaatgacatgtccaccgtcaagcttaaagcgaacattaatttaaatgggcgtttattttcccgataaaacacttgttaatcagttgaaatcacgaattttatcaatggattttcacaaatcgtacgcattgtttgaaaatgcaaaaaaaaagatcatccgtagatgacccttttttcatttatttttgaacgttttcggtataatcgccattcggacaaagcacttgcttgccacctttgaccttcttttcgaccaggtaatggccatccttcgggcaatcacggccaaccggtttatcccaagagacaaagtcacaatctgggaagcgggaacaaccataaaaaatccggttcttcttcgatttccgctcaatgacctggcccttcttacattgcggacaaacgacaccaatttctttaacgatcggcttcgtattacgacaatccgggaaacgggagcaggcaaagaatttgccgtaacggcccatcttcacaaccattggcgcgccacaaatatcacaattgaagcccgctaattcgtctttaatttggatcttctccatactttcctcagccgttgcaacttctttagaaaacggcttatagaaactatcgacgactttgacccagttttccttaccttcttcagtcgcatccaactgttcttctaaactggcagtaaagccgacattaacgacatccgggaagtattcctgaataatatcgttaacgatctcgccgagttcagtcggcacaaaccggcgcgcttctaatttgacgtagtagcgccgctgaatcgtatccagggttggtgcgtacgttgacggccgccccacaccattttcttccaatgctttgatgaggttggcttcagagtaacgtgcgggtggctgggtgaagtgttgttgcggatcagtcttcgataacttgaccacatcaccttcacttaaatctggtaagacgttattcttttccgtcttatcgtagatcttcgtaaaaccagcaaacttcgtcttcgacccgttcgcccggaattggacgtcattttggtcgatcgtgaccgccattgtgtcaagtacttcgggcgtcatctgactagccacaaaccgtgaccagatcagctggtataaccggaattgatccttcgtcaagtagtctttgatgctagctggtgtccggaagacggatgagggtcggattgcttcatgggcatcctgagcgccttctggtaacttgcccttgacaggtttggtggccgcatattctgcgccgtattctttatgcaagaattgtgacgcttcgtgcttcgcaatcgacgaaatccgcgtcgagtcagtccgcatataagtgattaagccgacgctaccttccttaccaccaacattgatgccttcatataattgttgtgctgccatcatggtcttacgcgtccggaaattcaacttccggttggcatcctgttgcatggtagaggttgtaaatggcggcgccgggaaccgtttacgttcttttttgacgactttgacgacattaaaatcgccattccggtctaattggcccaagattttttgcaccgcatcgttgtcatccaacggttgcttcttaccatgggttccataaaaacttgccatgaatttggaacgacccttttgaaattcactatcgatcgtccaatactcttggggtttgaacgctttaatttcattttcacgttgaatgatcaaatctagcgcgatcgattgcacccgaccggccgataacccctttttgacctttttccacagtaatggactaattgagtaacccactaaccggtccaaaattcgccgggcctgttgggcatccactagatccatatcaattgaacgcggttccttaaaagcgtttttgaccgtatccttggtgatttcattgaagacgacccggtttttatccttagggtcaagccctaataaataggataagtgccaagcaatggcttccccttcacggtccgggtcagatgcgaggtacacggctttggcttttttagcctctttccgcaatcccttaatcacatcacccttaccgcgaatcgagatatagtgcggttcatagtcgttatccacgtcgacacccatcttgctcttcggtaaatcccgaatatggcccagactagcgacgactttataagaacgacctaaatacttttcaatcgtttttgctttagatggtgattccacgatcaccaattttttagcgggtgttttgcttttccgcttggtagcagttttagttgcggtcttccgctttgccgccggtttggctttagttgtacttgcagccactcgatcagctccttacaggtttcattatcattattataaatatcagtttaagaaatccctgtaatcatatttcaaaaatttcgtgttgtcaaatttttggtaaaaactcttctattatatgtcgcgaatttaagactggtttggcccccgcaacgatcaattgattgcacccaactgaaaatggtgcatcaattggtccaggtaccgccagaacgttgcgattgttttgtaacgcgatattagcagtaatcagactcccagaatgggcctgcgcctcgaccacgatgaccgtttggcacagcccggcaataatccggttacgagcaacgaagtggtatggttccggacccacccccagtgggtactcactgattaataaaccgacctgactaatttgttgctgcaggtcacggtgttgacgggggtaactaatatccagcccggtcccaatcaccccgattgtcggtaagttaaaacgaagggcggtccgatgtgcaaaaccatcggctcccttcgctagtccactgacaatggtcaactttgccgttgctaacggtgccaataattgcgtcgtgacccgctccgcatacgatgtggcctgccgagcaccaacaaccgcaagttgacgtgtcgttagtaacgcacgctgcccgcgcaaaaacaacactaatggtggttgataggcttctaataaggccggtgggtaatcatcatccaagattgttaaaatatcaagctgcgcatggcgttttagtcgctgttgaaacgccatactttgccaatcagcggtaaaacgcccctgctgactagcagttaaatgggccaacttacctaatcggcggggatcagtgacgaccgtctgaacctgccgacagtgttgtaacacgcgtaccatcccggcatacccgatgccgtgcgctaaatgtaatcgaatcaataaacttcttaattgcatgttatcacgactccttaagttcgcccttgttgacattagtcgtcaacggaacggcttctttaaagagtagttacggatttagacccgcttagcatttcgaaccggtgaaaaagattggcgatgaatcggcgtagcgccgagactggccaacccggccaaatgcttagcagtcccgtagcccatattatcagcaaagtcgtacccgggatacacttgatcatacattgtcattaagtgatcccggacgactttggcgacaatactagccgccgagatgctcgcgcttttcgcatcgcccttgattagacgggtctgttcaattggtaccggcacctgcatcgcatcaactagtaaacgtgttggccggacggacaggttacggacggcttgggccattgcgactcgggtcgcctcataaatgtttaattgatcaatttgttgggcatccgcaacgccgattcccacggcgaccgcttcttctaggatccgtggcatcagggccgcccgtttcttagcggttaattgctttgaatcattgacttctagcaaatcaaaatgatcgtccaagactatagcggcagttacgactggtccagctaacgggccgcgaccaacttcatcgatcccagcaacgtattgtccgccgtgggcccaaaaatcccgttctaaacgcatatgttgattaaaacgtgtcactaacgccgcctgtttttcagcttgtcgcaaatagtgttgataagcctgttgcacacccttgcgatgatcggcttgagccgcggctagaagcgctgccgttggttggtcagccagtagccgtttaaaatccgcaatcgttcgttcaggcatcgggttgatcccccgttaagtcgagcgtaaaacgaccgagccggcccttgcgaatatctaagaggaaggccacgcagaaacgttcccagtcatcgcgcatccccgcatttttcgtcatcgcaatcagtaattccggatttggtaaggttaactgctcagccgtcaaatgataacgatcgactaagcgtgccgcgtagtgctgcttgaagaagtccaaggcaaacaaagcgacgtcatcgttaggatagatattttccttaatcgcacccgtgacggccagcttggtaccaacgacttggtcttcaaacttcggccataaaatccctggggtgtcgagtaattccaatttattggacgctttgagccactgttggcccttggtaacgcccggacgatcaccgactttggcaatttttttattgacaatatggtttaataaggtcgatttaccaacgttggggataccgacacaaactgcgcggattggccgattagtaatgccacgggccgcaattttggctaacttgtcagctaacatgtcactagccgcttgcgtcatttgcttaccaatcgtacgactacgtgaatcgaccgcgatcgcaagttgaccctggtcttcgtaatacttgacccagtcagctgtcgcttggggatctgccaagtccttcttggtcataattaagaggtgtggtttttgttggaccgttttttcaatttctggattccgggaagccactgggatccgggcgtcgaccaattcaaaaacaatatcaactaaatgtaaattgtcctgaatttgatgaatcgccttggccatgtgacctgggtaccattgaatatttgccattacgttgtgctcctttttctcgtggcgtgaatgccttcaaactttgatcattgttaaaattctttagcagcactggctgtctgctagctccagtggcgacatgcttaagtgctttacatcaaccgccactaatgcgttgattcaacgaaatcgttggtcgctatgccgcccatgaactaaaacaccggacgcttgctagtccaggactggcatgatgcagcaatctatattttaccatgtttacaccgaccatgctttgaaaccgaccattgatctgctgcccaatacttccgcacgttaatttagctaaccggaacatcgacaccattttattggctgcaagcttgcggtagctgtcaattagctcgttagtccaagcacatcgcataaccgtccttagcgttaacgtccaccgatacgatcatacaacagttcacctactacaaatgcaaataagcgcgacgtcacagccttcatcatcaagatggccgcaacatcgcgcttgtttgattgtcgtttgatagccgtcagctaattaactgacgtgacttaatcccagaatttagccgcaagcttttgtccctgatcaatctttgcccactgctgatccgccgttaactcgttgcctgagtcacacgaagcgaagccgcattgatgagataaatataactggttcttattcaaaatttgactagcttgtgtcagtaaccgtaacgcgcgatcttcatcatctaaggtattggtcttactggataacaggcccaagacgacttccacattcggccggtcctcaagtaccttgagcgctgaaagatcaccggcgcggtcatcgtcccattcaaggaagaaacggtcgtagtgttggtcatgcaggaatttcttagcaatcgtattgtaactgccttctgcaaagtgccgactttcataattaccacgacaattatgcgtccaaactttcaaccctaattgatggccaaaatcaactaactcattattggtgttgacggctacatcagctaattcttggagactgccatttccagcaccaaagggactttgctgattatcactggcaaacacttcccacaagcagtcatcgaattggatgattttgccacccgcagcttgataatccgttaagaattctttatacgccccgagtaagcctgcatgcaagtcatcaacagttttgtaaatctggtcagggccatatagcttatcgatgtatccaaactcaacaaaggcgtgtgcgggactccagatcgttaatttaacgtcattaccatcggcttgtgacttaagttgctgataaatatcgataaaatgatgatgcttgccagacagtggtgctgtgatttcaatgccaatatctttacgtgtttcaaaatcactgccgtcatgatcgcgaaaattataaccttcatccgcaatgaaccgccgaacaccactaaacccccaaataaaatccaaatgccacattgacttcgtatattcgccatccgttagcacatcaatcccatgcgccttttcggtggcaatcaccgtcttcactgccgctgtttcggcagcctggtagcccggcaaagcctcataaaatgggtattgaatatcgtcacgatgttcgatttgatttttataagtaagtaaactagccgggcgtaagagtgaaccgaccaattggaaatgtgtttttgtcataatgtaatcatcctccgtgtctgtcttaatgagtttattataacaatctgattaaaaaatagataagactgattgcattgatgatataataggcaacgcctataacctaaataatttattcaatcacaccagctacaatcatgcgttaattagatactgaaaccagacatttctcaggaggtgtacttaatgcgtattcaacaattgcgctacttagaaaaaattgccacgcctggctcgatcaacgaggcggccaaacagttatttatcagccaaccctcattatcccaagcaatgaaagaactcgaaaaggaatatcaagtacagctgttttatcgtcataaaacggggatcactttgacggatgcgggccgtgaattcattaactattctcgcagtgtcctcgaccaagttaatttactcaacgaacattttggtcagggaaccgttcgcaagcgtatctttagtgtctctgcgcaacactatgcgtttgtcgtgaacgcctttgtcgaattagtcaaggaaattggtggcgatacctatcagttcacattacgcgagactgaaacggccaacgtgctcaatgacgttcagactttgaaaagcgagctcggcgtcatttatcttaataagttcaatcagaccgtgcttagccgtttgattgctgacaaagacttaagcttcgtaccgctattcgaggctcgcccgcatgttttcgtcggtcgtgataacccattaacgcacaagcaagaactgactttggatgacctacgagactatccctacctctcttatgagcaaggcgatacgagttccttttattttgcagaagaaatcctcagtacgctacctcataaaaagcatatccgcatcagtgatcgggcaacgatcttcaacttgatggtgggtttaaacggctatacgatcagttcaggcatcatcagcagcgaactcaatgacgaaaaaattgtggcgattccactaaaagtggatgatgcaatgacccttggatacctgcgccataagaaaatcgaattgagcgctacggcccagcgctatttgacactattgaaacagcacattcaaggatatggctttgacgtttttaatgataattgactgatcgacacatgccgtgactgaattcattttttgttaacagcatacagtagcgggttgttttttgcaattttgatcaaggccttaatgtccaaaccgcaatcgccttcactaaagcaggacacctaaaccatttaaacatcatatatatccttttcaaaacccccgctgagtctggattaactcagcggggatatcagttttttatcttaatttattgatgagatttcaacacactcaaaattcaatcaatcttgttcataataatatgcatttaaagtatatgttttaataggggtaatctgtaattcatatttttcaactaaatcagctaactcctgaccatcgattagtgttaccgtattatttccctgcatcgccttagctttagctcggttagtgaaatgactagttgtcacaaaaataccatattcagcattaaaactatccatgacgcccttaaatttatcaatttcaggttcggatacctggtcctgcgtataccgtttgcactgaattgccacccggctagtacgaaactcgtcggatttaaaatagccaaagccatcgataccgtgatcagctgaacgtaccacaccacgatttttatcaatggtcacacccatttttgaaatcaatgctcgcgaaaagttttcaaactttccagaattgaatttttttaagcattcaattaaatcactcttccattgtgattcatctgcatcttgtcgcgactctggatcatcgattacgaccaaatcctcatccctatctgccaacttgtcatcagattcctgcattgctgttaatttccgatgtactctttcacgtgtcttttgattccaatagttcgtaactagttgggtttgttcagaggtcggataatttgataattcagcagttctgccggtacttgtcagtgaaatttcctttccccattccatggaactaatatagccaactgtaagtagattttttaacccaaagttgaaatcgtatagcaagggattatacgctcttccggtccgtgcactgactttagtatcatagacatcctcatacttcagattagcatattcatttgtagcaattgtctggcgtattatttttcgtgaggctgttccaccaagttcccgtagtgctaaaacgattgccttctctacattccaacgcttataactcatttcaaatgccaactttcaaatttaatgccaactattttttgacacagcaaactgtcaatattcggcttcaaaatttattctatcatgtttgaattagtcttgcgttgtgcgtttccccatctaaccaactaagatcacgaaaaaatacgacattcaggttgaatgccgcattttagtttggtttagctactcgtttgtttcaacatccaatgcatgtttggccgcaagcgcacgaccaaaatcagtttcatcaaaatgatcaatgatttgctgaagcgcggtcgcacttaaactagccccaaataacggactgccgggctcagtcataatcccattcgccagtcggggatagctaatgagatcaaacccaagcgtctccacaaagtgggccacagttgctacggcttgaggctcatcaccagctaccaatagggccttccgcgccggatcgccattaggtctggcgtcttcttgcagattatgataacccatatggttcagtgttttaaccagatggctccctttgaagtattgctggacttgttcgctggaggacgtctggggatccagaacttcttcccgtaccccgtctgtttcccaccaataattcatagcgtcaattacaagtttgccatcaagcgccgtagccgggatttgccggtaacgactcagcggtaatgctaaaataattaactcactgttggcgatgacatcctgattttccgacgcaattgcacccggaactagtgtttgaatcgttagttcaattttgcttactttgccagagcccgaaatgcgaacgtcatacccggccgccaatgccagttccgctaagacgataccaactttaccggcgccgaggattccaacgtttttgactgtcatttggtcgtcacctgcttcgcttgtaaaatagttttaacttgtggaatcacctgtgtcgcatacaattcaatcatccgttcacgttgagccgccgtttgattaccggccccgtataccaagtcaaagcgccccagccctagtgtttcaatcgtcgtcgcgatccgttgcgcaaccacggtcggcgtcccaacataaaacgacccgtattttgtttcacggtcaaattgttcgtgactcattggcgcccatccccgggtcaatccaatgcgatcaaaattagctttgatattttgataagccaccgtcaaggcctcatcctgatcatccgcaatgaatccatgcgaatgcaccgcaatcggataagctggctgattgaactttttagcggcttcgtgatacagtttgatatacggtttaaatcggtccgcccggccaccgatgattgcaatgatgactttatagccaatcttagccgcacgaataattgattctggtgaaccaccaatcccaatgtaagtctcaagttcaccagtagctgtctttggatacacgtcttgattcgttaacgaagcccgaaacttacccgaccaagtcaccggcttttccgttcgcaattggtcatatagtgcgagtttttcgttaaataggtcatcataatccgtcaaatcatagccaaataacgggaacgattcggtaaacgacccccgtcctaacatcacttgggcgcgcccattagacagaccgtctaacgttgcaaaccgttcataaactcgaaccgggtcatcggaactcagcaccgttactgctgacgctaatttgatgtgctgggtcatggcagcggtggctgctaacaccgtttccggacttgagacactgtagtctggtcggtgatgttcaccaatgccaaaaacatccagcccatactgatccgctaactgaccttcgcgcacgatttggcgcaatgactctcccgccgactgtaaactaccatccgcgttcgccacaatatccccaaatgtttctaacccaaattctagttgattaacatcaatcatcttaatgcccccattacttttattttgcttacttttagtaagtgattgatgttaatatatcgtattatctctttaaatgcaactgataggcacagcttgacagtccccttcaatcatgattaaaacaatctgccaattggatgaattccggttcggtagtaattcagcgatacaagcatcgcacagaataaaaagaggtattcaattagaatacctctccgtaactcatccgtaagttgttcagaaccaatcatcattgcaaaaatcaagtttgcacatgctatctagctctgggcctgccgttgcgtctcatgacgttgtgcccataagttgatcactaaagcgacaatcattaatccgaacgcaacaatcatgatattttgtagtccagtgtgtaagatgccacgcatcatcggcactaggtgcgctggtagccggcccgcccgactagcatcacttaactgattcatcatcgccatggtgattttaccatccgattgtgccaccccactagtcaaagcttggttcatgattagcccaaagatagccgtggtaaacgtctggctgagcatccgaatcaaataactaaacgaagtcgcaactggaatgtcacgttgagcagcgtctacttggaccttaacctgcagctcattaaagcaggccccattgccccaaccttcaaagaagccagctaagagtaagacccagtatggaagcttaacaccgccaatcatcaatggaacgaaggtcagcgtcaaaatgataatattgatcgtcaagacgcgatggggcgtcaagcgccgccgcatgcggggaactgattcactacccccgaaattagcaaaagcacttggaatctgcgtggctcccccaattaacgctgacgtccctagcaagccctgagcccacatcggactgtacgtcaaaaaggcaacgaacgcgccccaaataagcacaaataagacgaaatcgaccactaacggcgcgttcttaaacaggcggcccggaataaccgggtccacagcgcgacgttccacgatggttaaactgcccaatacaatgagcgcccccacgatcacgatcgcgacaatccataacgacaccatgccgatcagttcaataccaccaagcaaactgatgatcccaaccgccatcaataacgcccctgcacgatccattggttgcaagttatgttcccgcttaggctcttgatagaaaatttgtaacagcacggctgagacaatcccaattggtacgttgaggtaaaagatccagtgccaagaccacacatcgacaatcacaccaccgaccatggggccaataatcgttgccatactaaagcaagccgagactagtcccagtgcccgcattcgatcacgcggattcttaaaaatatccgcatacatgatgtaaggtaaggaaatcatccccccgttgccgagacccgcaataccccgagcaataatcaaaaaccagatgttgggtgctaatccttgtagtaaggagccgacaataaagagtgccgtcgtcatttgataagctcgcttattaccaaagcgctcacccatttttgaccagatcaaggtcgaaactgccgttcctagtaagaaaacagcgacgatccacgccattaaccgtagaccgtgtaaatccgcaataattgctggtagcgccgtattcacattcgtactatcgataccagccataacgttcgatagtaacagggcgccctgaacaaaataaatggcccgtcgattcacaacaaaacttctttctataattgctaaacatctcgtcagtcgttcagctaaaagttacctcaatccaacccgttgaaattcactatttcatactgatcaattaacgcacaatttctagtataccgctttacccccaccgcaaggcaagtctaaatcttgatttaaattcatgatgaataagactttccactaccgatttataaagcacccgtgacaagccatttttgagcctaattcgtaggtccacctccatcttgtcaaagcttcgttgacggtgctgcattaaaattccgcaactaaaaaaggcgtaaccgaaagccatgcggatttcagttacgccttttaaaatatacgaatcagctttgaactaatttgtcttttcaatcaatttcattgctgcatcgtaagcccgatcattatcactgatcttattagctaattcagtctcgatcttagtcagtgtctgtttatcgaccttgccattgaccgttaacttggcatgcttttgatactgcttgaccgcactggtggttgaatcaccaaagtagccattaacggttcccttaaagtaacctaaggcttgcaagtacttctggaacgtcttgacattgctattgaccttgtcagcttgtaaatcactgaccttgttaataaccgtcaagcttgcataactcggctcatcagctttaacatcaggtgtcaagcccttcttgttgatccaagtgccatttggtgtcagccacttcgcgaccgtgatcttcatctcagtcttatcattaaaagtcgtcaccgtttgaacggtccccttaccatatgactgtgacccgaccagtttaacacctgccgattgatgcaaggctgcagagaagatttcagctgccgaagcactcccaccatcaattaagacggtcgttggcttcgtttctttaaagccaccatcatacttcttggacgccgtgtatttttcggtcgaaccatcgcgtgcttggacctgcatgatcgtcttaccattcttcaagaagattgaggccatcttcaaggcagccgtcatcaacccgccaggattaccacgcatatcgatgactaacttcttggcccccttcctatcgagtaccttcaacgccgtcttaaattccttagcagtattcgtcgagaaggtcgataccgtaatataaccgatcttcttatcgccaccgactaacttataatcaacggtcgtcactggaatcttagcccgcttcaaacttacggtaaaggtttgaccactgcgttcaatcgtcaatttgaccgtcgtaccaatcttaccacgcatcatgctaacggcttgtgtcaaggtcttaccggccactgacttgccattgaccgccttaataatgtccttcggtttcaaaccagctttcttagctggcgtaccagcaattggtgaaataatttgaacatagttgccagatttttgaacctgggcaccaattccagaaaacgaactgtcgatcgtgtcattcaagctttccgtctcgctcttgtccatgtactcggaaaatttatcacctaacgaattgaccatgccgttaatggcaccgttggccaacttattcgcattgaccggtttgtagtaattctcattgatcgtttcataaactgattcgatctttttcattgctttactagtctgctgcatactgctgagctgggcattgacttgccgaccaatcagccagtacgtcccacccaccccaatgcctaatgcgacgacaatggaaataatataggtccatagaccaacgcgtcgcttgggccggggcactttttttatgtgcggattagtttgtttgggttcctctggcataccgaacgtcctctttcctacaaattaatttaagcttcacttgccaaataggcttgccacgcgtcatcaaagaccgtcatcgttggcaaataaccagcgttcaattccaaatattgtgagagttcgtgaaaatctttactctgctttggaaacgattgatccaaaaacgcattattggcaaattcggcaatggcatcggtactgtctgggttccgttgcgtcatcaagaatgtataaaatgttttatgcatgaattcactccttagtcactagtttttggaatatgcatttcgaacttgaactgattattcttcaaatcaagcttatctacactataacaaacatcatgtttaccaactaatttattcaagtagaggtcgattgtcttcttcttggcattcaacttgacccacttaggtgtcttgtaattattattaatataattaatcacaaagctgattggcaaggacatcgtcccgaccgataaattggttgctttcaacgaaatattgccgttatcgatgacacttggttgcatcgtgatcacaaacgacacgttctgacccagtacctgcgtcgttccgagcaaataagcgccggtagaccggaccacgaagcgatatttcatgtcttggcccttttgtagatcattcaaataataactcgcaagggcgtttaattgttttcgattcattgtaatcggcacactagccgcatccgtattgcttgcagccgtcaaactagtgctttcgctaggcgatcgtaagacctgggtgccgacgtaagcaccggtgccgacaatcaacgcaatcaagacaacggcgacccatttccaaacattgattggaccgtttgtcttcggatttttaggtgctgatgcctgcttgtttcgttgtgcttcccgcatctcattacctccctattttttgattaaccacgcatcatgggccatcatggtctgatacagtttggttgtaaacacacgatacccccgcttattgggatggaaattatcagcagtcgaaatcaaatcattcgtcttgttttctgtctctaaagcgccagtaatggcctttgagctggttaagctagttaaggtcgtggcactcgctgctttcttcaacttgcgaatctgggctgccgtcttgtactggccgtgtgacatggtccaattgatatccataaaatacgtgtgcttgtattgactaaccgtcgtctgtgtctgatcattccactggctaatgtagtgcgtgatcgacgtcacatttggaaagttcacataaattggattatagatgctaaagacaaaaactgacgcagtgccattcaaactttgtaatttattaaataatttagttagtttattcgcatataaagtttgcgctttagcaaccgtcgcgttatttttggccgtattgttagaagttagggacccttcgagcgtttgcaagaggtcgttaccgccaaccgtcacagtaatcacatccgccttggcaattttctgttgtaacactttcgacttattaatgcgtgctaaaatctggtcactccgatcaccggacttaccagcattcgtggtcgtcaccttcagcttttgcttagtcgtcaacgtttttttgatctgaccaacgtagccaccctcggactcatcgccgaccccttcggttaaggagtcaccgaccgcgaccaagttgatcttcgccttgtggggcgtcttcttggcagtggtctttttagtcgttgttggggtagtcgtcaccgattcattttgcggatgcagcagataattgaccccgaaaaacaccccgaccgctaacaccgccaccactaaaatgattttgatggtttctttaactttggacattggcatccaacctttcttcaccgttgagcagtccatttaatcagagctaactcatctttgaacaataaaatggtcaccatcccctgttgggacgatcaccatttgccattagtgctcatagacaagtcgcctgtgggacaccgctcactttacgctggcgcttgcgtatgatattccacggcaaacgcacccgggccaccatgggtcgcaataattggcaccgttggttgaacactgatcttgagacttggtaaagccgcttgtaggcgcgcccgatattcttccacgcgctccgtggcgccaacgtgagagattgcaacttcggcgacgttcggcgttgcaataatatcatcgagaaccttatcaaaaaacttattaatcgccttaacaccgcgccccttcatcttcacatctagggtgccgtcatcaacttccaaggcaatcttaacattcagtagcgtactgattgcccccgtcagacgactgattcgaccaccagcaacgaggttattcagggtcattacgcccatgaatagcttggtatgggcctgagtcgcatgaatctgatcgatgaccgcctgtttgtcagcaccactctgggctaacttagcagcagtcaaaacttgaaaggccatcgcacggtcggtcgtccgagcgtcgatcacggtgacatcggtcttcgtaatcgaagccgcttgttccgccgtgtgcactgttcctgaaatggcttcgagcatattgatacaaatcacactcgcgccatccgcacctaacttatcaaacgtttcaatgaacgttccgagtgccggttggctcgtctttggtaaagatttagccgttgccatcttgtcaataaattcttcacgcgtaatcgtttcatcttccacgtaaatggtgccatcgatcatgacagtcaacggaatcacggtaatatcgtatttttttacctcggcatccgtcaaatttgccgaagaatcggtcacaatcttgattttcgtcatactttgccacgctttcttatacttgtaacgtttaaacgatcgttacaataaaattaatgctttcagtatagcagaaatctgcctgagtttcacggttgccactgaattaacgacggcggaaatcatcaaattcgtacggatattgatttttctcatccaccgtcccaatttgttggctcaccagctgccactgcgtgtaatccacggccggcatccaagtatcaccatcaaaccttgcgttgatacgcgtccgatataaataatcggccaccggtaacacggcttcaaacaccaccgcaccaccaatgacaaaaatcggttcatccggatgggcagccgcgagtgtttggatcgccgccacatctgctagttgatggacttccggtggcaactttaaatcagactgacgtgagagcacccaattggtccgccgtgggagcgggcgtttaaagcccgcaaaagtcttgcgccccatcacgacatggtgtccggtcgtcagcgctttgaaccgctgcatatctgctggtaaatgccagggaagctggccctggttgccaatcaggccattttgatcttctgcccatatcaatgcaatcattgcggcctcctaaatcgcgaccggcgctttgattgccggtgcgggatcataaccactgagcttaatgtcactcatttggtaatcaaaaatactgtcatgagccccacttaaagtcagctggggtgctggccgaggttgccgggtcaactgcgttttaacttgttccacatggttagtataaatgtgcgcgtcacccaacgtgtgcacgaactcgcccactactaggcccgtctccttagcaatcagatgtgttagtaacgcataactcgcaatattgaatggcacacctaggaagacatcgcctgaacgttggtagagttggcaagagagcttaccatccgcgacatagaattgaaacagagtatgacacggtggtaacgccatgttcggcacatcttctggattccaagcggaaacgattaaccgccgcgaatccggatgcgtcttgatcatttcaatcacattggcaatttgatcgatcgtctttccctgacgcgtttgccagtgacgccattgcgcaccgtaaacgtcacccaaattaccatacttggccgcaaacgcgtcgtctgtcaagatctggtcatcaaaggcctgtatctgagcttgataaatcggcgcaaagtcaggatcatctagccggcggtgttcaaaattcgtcatatcagggccgtcataatcggcactcgtaacccaatttttgaacgcccattcgtcccagatatggttgtgatgttgcaataaatactgaatattcgtatcaccatgcaaaaaccatagtaattcgctcttgatcagtccaaagggaacttttttggtcgtcaataacgggaatccttgactcaggtcaaagcgcatctggtaaccaaacacactgtatgttcccgtgccggtacggtcatccttatacgtgccgtgttctaaaatggtgcgcgcgagttgtaaataactatcttctaacatgcgatcatcctttcaggcttctgcatactggctgaggtagtcccagcgatccatcttctcatcaatcgtttgttccgtcttagtcaattctttttgcaaatcagccaacttgccataatcactggcattggcagccatcgccgcttcgatctcactcttatggctatccaattgctcgataaccccttcgatcttgtcgtattcgagctgttccgcgtaagtcagcttgactttggctttcttggccaatggtgcggtcgagtcatccgtgaccggcttagccgtagtttttgtcgcagtggccttggctgcgggcttggccgcgtctttttgatccttcaaataactggagaaacggccagaatagcgttcaatatgcccctgaccatcaaaaatcagtagtttcgtgccgaccttgtccaaaaaatagcggtcatgggaaacagtgatgacggtcccggcaaaatcatcgaggtagttctccaacaccgttaacgtaccaatatccaaatcattagtcggttcgtccaataagaggacgttcggctgttgcatcaacaacttcagtaagtatagccggcgctgttcgcccccagataacttgcgaatcagcgtgccgtgcatcgaacgtgggaacagaaactcttctagtaactcagtcactgaaacatgctcgccctgcttattcaagaccgtctcaccgacatcttgcaagtaattaatgatgcgcttgtcgcccggaatcggttcggtctgttgagtataataggccatcttgacggtctcaccgatcgtcacggtcccactatcaagtggcagccgacccgcaatcacattcaataaactagatttcccggcaccgttgattccagtgataccgatgcgatcattggcttggatcaacatcgaaaagtgatccaggatggtttgccgatcaaactgcaagctcgcgtcctttaactcgatcactttcttacccaaacgctgctgaccgagcgaaatatcaacatcgttatcaacttggagcgtattcaaattatccttcaaatcattgaaccgattgatgcgcccctgttgcttcgtgctacgcgcgggtgctcccgcacgcatccaagccagttcctttttgtacagctgctgttgcttatgttcagctaacacgtcacgggcgacccgttcggctttcgcttgcacgaaatcttggtaatttcccgtatacttatgcagctcgccaaatgacaattcaaacatctggttggcgacttgatccaagaaataccggtcatgggtcacgacaatcaaagcacccttataactagctaaatagctttctaaccactcaattgagtcaaaatcaagatggttggtcggttcgtctagtaataaaagatccggtgattgaatcaacacttgcgccaggcccacccgcttctgttggccccccgacatctgactgacggtctgcgtcaggtcggtaatgtgcagttgtgtcaaaatcgttttgacatcactttcagccgtccaagcatcttcttggttcattcgatcctcagcggccacgtaagctttttgggtcgcttggtcttcgggatgatcagcataagcggccaacgtttgctcgtagtggcgaatcgttcgaaagacttgctgactaccggccaaaacggcatcaatgactgtcagattctggtcaagttccggcttttgctttaaataaccaatcgtataatttttgggcatcaccagttgaccggcttccggtgccgtaatcccggctaatacgtctaataaattcgttttcccggacccgttaacgccaatgacaccaatccggtcatgttcattcacaataaatgaaatatcgtgaaataacgtcttctcaccataagttcgggtcagattttctgctcttaaagtttgcattgttacgatccaccctttttttacatcattaagttctatcttagctagaatcggcttaaaacacaactgacaaacgcgcaaatcaacgttaatatttcctaacgatcatcgattcgattgggtcgtgagtcacaaaaaaactcctgaggctcactcggccccaagagttgtttggcaacaccttattagttatgatcaccataaacatcaaagacggtccgttcatcatcaacgactaagtgtaattttccatcgctggctaatgagctcgtctgataaatgttgtcgataccatccgcatcccgtggcttgaatggcaagtaaatttgttcactaccacgttcgtcgccaaacaggatgtcaattttttcaatgtcttgataatgcgtcacccgttcaaacatcccacttgtcacggatgatagttgggtcgtgtccggatcgatcgcatcagcgtcaggtttaaattcagccttaaatgatttacaaggatgaatgatggtcatatggccacccttaattcgaccgtaactcgtcgttacccggccgatccacaggtcagagatatcttgatgatgaactgtccaagtgtcaccattccgaaaatgaaatttcaatgcttctaatgctcgttccattcaaatcacctcattgaattagtttcactttaatcgtaacagattcatagaaaatatcaatggttttttgaatccgctaccatccttgcaaaatcaagcaaagcatcctgctgatttgggacttgtttcatcaccacggcctgtaagcaagccgctagaatttgacccatcattggcccaggcgtcaccaatttagctttcaataaatcgccaccgttaatggccaattcatgcttgtcatggattggtaagctagcataagattgcaccaattgtgcttggtcctggccaaagcctaaaatcgtagccacctgattagccgttttcagcgcctctaagcccgtataaaagttctcctgcgcagttaactgaccgttgtgttttaacgccatcagcgctttaatagcggccgtcacgtgattaatcagctcattgctcgtcttccacgtctttaacaactggcgaacagccgcttcgtcagtccgttgcatggtccagctaagcaaggtccaagtactttcaatactcggcaaatgccaagctggaagtgccattaactgccgcagcatcgcttcttgatcagccattgcgggcatataacgatacaagtcagtggtcagcaagccggtcaaaccagcaactgggtgctgacccatcagcagcttctcccactcgacacgcgtccgttccacggcaattttcgccaacaacgccgcattatcggcaatcgcttgttcggtctgcgattcaatggtaaagcctaactgacttgcaaaccgaacggcacgcatcatccgcaacgcatcttcgtgaaaccgttcttcagccactccaacggcgcgtaagattccttgttccatatctgctaacccgtcaaacagatcaatcacttcaccgttagcagtcatggctaaggcgttgattgtgaaatcccggcgcttcaggtcctctttcaatgatcggacgaacgtaaccttatcagggcggcgaaaatcttggtaaccagattcagtccgaaacgtcgtcgtttcataaccattgccgtgatctaagatcatcaccgttccgtgctcgattcccgtatcaaccgtccgtttaaataattgtttgacttcagccggaaacgcgctggtcgcaatatcgacgtcatgtaggggcttgcccaaaatcgtatcgcgaacacacccaccaacaaagtacgcctcatagccggccgcttcgatcgtctcaataatcggcttagctgcttgaaactcagctggcaactgcgtcaaaatcatagtaagtgctccaaaccaacaaagagttcgtgatactggttaactttttcaaccgccactttgacaccagtcataaatgagatccggtcaaaggaatcttggcgaatcgttaacccttcaccagggccgccaaacatgacctcttcgtgcgccactagtccaggtaaccgaaccgcgtgaatccgcatcccttcatattcggcaccccgtgcgccaggtagagtttcagttgcgtcaggattaccttgttcctttggttgccgaacttcagcaatcttcttagcagtactgatagcagtaccacttggcgagtcaatcttatcgtcatgatgcatctcgataatttcaacatctgggaagtacttcgctgcttgttgggcaaattgcatgagtaagacggcactgatcccaaagttaggcgcaatgaggccgcccacttgcttgtcctttgctaatttttgcaactcggcaacttgttcatcggtcatcccagtagtcccaataacaggcgaaataccatggttaagtgcaaactttgcattttcataaacggcggttggaatcgtaaagtcgatccagaccgtggcatccgtcttaatttggtctaaatcatgaaaagctggcacgtcttgacccttaaagcggtcgtcctcacctagattttgttctccactgcgcgcgtcatagaccccaactaattcaaaatcaggattatcaatgaccatctgagcagccgtactacccatccgacccttatagccggcaacaattacttttaccacaataaattcctcctcaagattaagctaattatattttagcagacaattgccaaattaggcaggagaatcctcgccgaacctgtttaaactgttaaactagccccattttgttcatgcccaatggctaaaacggtcccgctaattaacttgctactttgtgggacgatccacgtccgtcctataacactgatatgaataaaaaatagtgtctgactcaaagcgtagtcccgctcggtcgaacactatttgcttatatatttcggccgccaacaacacctggtgacgctaaattaacgtgtcaatcgtcgctaacaccccatcatgattattgtcatgtgacgtaagatacgtagccatctctttgacgggtgcaatcgcattttgcatcgcaaaactgtaatcagcctcccgtagcatttcaagatcattaccgttatcaccgaacgcggccgtttgactaggggcaacgtgccaatgttgctggagataagcaagcccggttgccttgttaacatgtggtggaatgacgtcaaccccattaccaccgctgacagtcgcccgtaaccggccagcaaattgctgattgatcaaagcggcgtgcgcatcagcatccgtggcttgccaactaaaagtcgctttatggatatggtcatcaattgctgatagcgatggcaccacttgcagccggctcaaatagtaccgcatgatcggactgtcatcttggggccgaatatatgccccttgcttgccggagaccgagatctcagcaccagccagtgctggttcagtcgccacgtaaattaacagttcctgataaagcgccggctcaatcaagctttcagccaacacgttgccgtgattatcaatgactaacccgccattttcagccacataggtcaattcaccgttgatcccgtcaaaaacatcaatacaatgttgcagctgattgccgctcgccacaacaaagtgctggccctgagcattcatttgatccaactgggcctgaaaccgatggtgatcaaactgatggtcgtctctcaaaaacgtgccatctaaatcggtggcaattatagctactttcacgatagtaaacgcctcacttgaatttgatatacgttcattttaccaaaattgaaagtggtttcaataactttaggaatgaaactctcagcaagcggtgaagaactaaaggcctagtagccctgatcctcgtagtcttctagcatcgcaaccatttcaccatcatctggttcaatcgttagataattccgcaacgctgccacggcactgtcggccattcctgcttcgcggaagaaataaattgctggtttaaggaaatctttgttatgttcaaagaacggataagccgcttcgtaattatccttagccgcctgaaaatgatcgagccggtcattagagattgccaagttccagtagaactgtggatcaaactcattactttgcaaatattgatccaacaagtcgatattgtcttgataacggtcccgctgaactaacaaattagatagttccaataccgtggtcaagttatcagggtcaatactcaaaccttcccgcaaatacttttcagctaattcctgatcgtctaatttcaaggctaagcgggcagtttgcaagtacagctgctcattgtactggtcgaccgctaaaccttcttgtaaggtcaataacgccttgtccagttgatgaagttgctcttgggcctgggccaagtatggatacagggacgcatactgattgtcttgttcccgcagtttgtcgaagatatcaacagccttctggggttcgtttaattgcaaataagtgaagcctaattcaaactggctgtccggcgtgagcttggcaggcttgatttgttctaaatagcccaccgcctgctcaaagcgcccggactcagcataagccacccctagtcgttcaactaagttaactttagagatctctagttgtccctgcttgatcaagtccaagtagaagcgagtcgcctgaccgtagttacgaatcaagaagtaaaattctgcgagcgcaaattcgacaactggttcgtccggtgccagctgataggcttccttgagtttttgctcactgacttcaaataactcttgggtctggtatagatcggcctcaactaacaacgcttgaacgtatgccggtgagtctggcttaacttgttgtaaatagtcgagtgccaggtccgtatcgtcctcatcgatggcaatatcagccagacttgtccgtaagtcgtcctcatcgggatacttagccagtaacttcttataagtccgttccgcttgctttaaaaagcccaaaccgtacaattcttcagccagactatacagcgtctggtcatcgtccttacgtaaggcccatgcaaagtgctttttggccgtgtcaatttgcccgtttgatagtgctgcgagcattttttctgaataactcattacacccatcctttaaaccactaagaaacgacttcatttagtcgccatggtttcatcatttatttcaatagtcagcctgatatcgtcacatgggataccagctgttaatcgcttgacctgacagtctatcataccgcagacgacagcaaaaaagccagtataacggtcgctatactggctttcatgtttgcatttcattaactgatatgcattatttaactgcgtcctttaaagctttccctggcttaaatgcaggtactttgcttgcaggaatttggatttcgtcaccagtttgtgggttacggcccttacgagctgcacgttcacgtacttcaaagttaccaaatccgatcagttgaactttttcaccctttgcaagagtgtcttggattgatgcaaagactgcgtcaactgcagcagttgcgtctttcttcgttaagttagttgccgcagcaacgttgttaactaattcagctttgtttgccatgtttgattcacctccccgttacagagtgaaggatcgccgtgctttttaacatcgttgatccagatgatcatttttgagtggtccaaaaatgagagaaacgataacaagcatcatttcttcatcaaagatagcataggaatgctgtaatagcaagcttttttagccttttcagcgaaaatagcgcaaaaagatgataatcgtttacatcaatcaaataatgtgctaaaatgctgattttacgcgctttagcctacttacgtcgccgttcgatcatgtggatcggcgtaccactaaaatcaaaggcattccgaatttgattttcaaggaaccgttcatatgaaaagtgcatcatatcagggtcattcacaaagaccacaaaagttgggggttgaatcgccacctgagtggcatagtaaacccgtagccgcttaccattgtcactcggtgtcggattcatcgcaatcgcatccataataacgtcatttaaaacggacgactgaatccgccgcatatggttcatattgactttcttaatcaacgcgggtagttgctccaaacgttgattagtcttagcagagacaaaaataatcggcgcatagctcaagtaaacgaactgatcacgaatatacgcttcgaattcttgcatggtgtggttgtctttcttaaccagatcccacttattgaccacgatgataatacccttacccgcttcatgcgcataaccagcaacccgcttatcctgctcacgaatgccttcttcaccattgatgacaaagagtgccacgtcactattatcgattgccttgagcgcacgcataacgctataacgttcggtattttcgtaaacttttccttttttacggataccggccgtatcgaccatcacaaaccggtcaccatcctgatcagtaaacttggtatcaatggcatcccgggttgtcccggccacgtcagaaacgatgacccggtcttcacccagcaaggcgttgacaattgatgacttacccacgttcgggcggccaatcaaactgaaacgaatcgtccccggttcgtcctccccacttttttcaggaaagtttttgataacagcatcgagcaagtccccaagtccgagtccatgcgcacctgagatagggtacggatcgccaaagccaagggaataaaagtcatagacttcactccgaagttcaggattatcgactttattaacacccagcacgaccggtttgttcgaccggtacaagatttgggccacgtgttcatcagcgtccgtgacgccttctttgatgctaactaaataaataatgacatcagcttcatcgattgcaatttcggcttgctgtgtaatctgtttaatgaatggggcatcttcgatatcgatcccacccgtatcgatcaaactgaattcttgaccaagccattcactgttggcgtaaatccggtcacgagtcacacccggtgtatcttcaacaatcgagatccgatcacccgcaatccgattaaaaatcgtggatttaccaacgtttggtcgcccaacaatggcgacgactggttttgccatattaattcctcctttaccctcgtagcgtcaggttcctgctacaagtctcaaattaattggtaacaccaactaatctgttcctaaaaaaatatccttcaaggcaagcttgaagggtatttttaatcaatcaatgattagttttcatcattgttgctttcagcattcttcaattcgtcaccgatcaaatcacctaaagtgaaaccagttgattcttcaggagcattagccgttgaacgttcgctagcagtccggttgtcccggttgttgttacgacgacggttattgttactccgacgttctggttgactttcgttgtcatcgtcagcagtttgtggcttttcttccaaagctttaattgataaagctaaccgcttttcgtctggacgaacgtctaagactttgactttgatttcttgaccaacttttaagacatcgtttggtgttgcaatgtgttggtgtgagatttgtgaaatgtgaactaacccttcaacaccagggaagacttccacaaaggcaccaaaactcgtcaaacgcttaactttaccatcaagtacagccccttgtggtgctttttcttcaataccatcccaaggttctggtaaggttgctttgattgataatgaaacccgttcgcggtcagcatcaacggataaaatcttaaccgtgacttcttgaccaaccttcaatacatcagcaggcttttcaacccgttcgtatgagatttctgaaacgtgaaccaaaccatcaatcccgccgaggtcaacaaaggcaccgaagttcgttaaacgagcaactttaccttcaacgacatcaccagcttgtaaggtcttcaaagcttcttcacgttgtgcttcgcgttgcttttcaacaacggcacggtgtgataagatcaagcgattttcgctaggttcaatttcaataatcttaagttcaagttcttggcctttataggcatttaaatcttcaacataatgatcatcaatcattgaggcagggatgaagccacgaacaccagcgtcaacgactaacccgcccttaacaacttgcgttaccggagctttaatcgtatgacctgcttcgtattctttttcaacatcgtcccaaactttgcgagcttctaaccgacgatgtgacagtaaataactgccgttttccttgtcgctgccaattcgagaaatgacaaccaagtctaatacatcaccgactttagcggcttcgttgacatcgtcaacccgttgtgttgagagttccttcaaaggaacgaccccttcaacaccggtaccttggataccaacaattacttgtttgtcgtcgtcgattgctaagacttcacccttaacaacgtcaccgacgtttacttcttcaacgctgtttaaagcgtctaaaagttcatttttctcttggctgttttcgttttcactcatgcaaatttcctcctgtcaacaataactctaacctatatcatagctgaaaatgcaatgaaaagctagctaaaagcattaagttaatgcaattagattgttgaactttgtttttttgtaataattttggcaatggcagcaacaacttcatcgattgacattggcgtcgtatcaacaagtgtggcgtccgttgcttgtgttaatggtgacactttacgcgttgaatctttgtggtcacgtaattcaatctcagcctgtagctgagccaagggcgtgtcgatccctttttttacattttcggcgtatcgacgcttagcccgttcagccgctgaagcaactaaaaagatcttaacttcagcattgggcaataccgttgtcccaatatcacgaccgtccatcacgatcccacctgcattggccatctctcgctgttgctcagttaaaatcgtacgcacctgtggtaacgccgcaatcgtcgagacgttattcgtcacgtctggttggcgtatcgccgccgtaatatcttcctgattagcaaaaaccagttgatccggctcgccgggtttaaaactgatcttgagcgacttcattgccgtaatcacagccgcttcgtctgctaaatcaacgtgctgttgcattgcccagtacgtgactgcccgatacatggcaccagtatccacataaatatagccaaaccgttttgcaacgagtttggctacggtactcttgccagctgaagccggaccatcgatggccacctgtaatgcttgcttagccattaactaacccctcacaatctgaaaaaatcgtgtattaacggacacgtaaccgttgaccagccgaaatcgttgcatcagatgataacccatttaattccaatagcttatccactgagattccagcattcgtagcgacccgatagaccccttgaccggcttctaccgtgacgtacttagtccctgaagatgattctgaggagctactactactgctagcgctgctgtcgtcagtactcgcactttcttccgagctggcagcagtagaactagcagccttggaactggcagctttagagctagccaaggctaggctactacttttagcagccgcctttttcgacgatgcggccgccttcttcttgctagcagcagtcgatgacttactggcagcaacactggccgatgacttcttcgagctcgaactagcaacttgttcagtctgttgcggattattaagcgaattctttttcaccaagaaataaccaattggtgccaaagcaagcaacaatattagtacgactaacacggtcgttagcgtagagttgctactgtcttgttttcgtttttgagttcgcgataaattgcccgagtcatcccgatcgtcttcaaaagttttgtcccacggcttatccgcttgggatttgtcattatcatttttttgactcatagggtgttcctcctcaaaaaactttcaaccaatattgtaacataacccggaattgatttctttaagaatttggtaaaaacaattgagctaagttctgatcccacgacattatcgtggctgttgactcatcatgcgtcgccatcaaccctaacgcagccagcggtagtggttcaccagccaactgacaacactgatctgtatgggtaacagctggctcaccaaagtaagttaacatcacggtccgatgacaagttgtcgtttggacgtaacccatgagcgcccgcaattcacgttccttagctgcttggcgatcagcaaaaatcgttgccacggtcgttgggggagttccttgtagccagtatgactgcaaaaccttactacgatcatcagtcggtggctgctgcgcttgataacggctataatcttgctgaatttcattgggagtcgcagccgtcaattcgttcaaattccgcaccaggttttcgtcacctggtgcgtacaacataatcgccatcgcctgctgaccatcacgacctgcgcgcccaatttcttgaacatagtcggccaaagtcgtcggtaaatgatagtggatcactaagcgaatatcagctttgttgatacccattccaaaagcagatgtagcacagatcacatccaattgtcctgccatgaactgctgctggatcttgaaacggtcatcggtcgctaagccggcatgataagccgcgacccttaacgtggttgtcgttcgtagccattccgctatcaaatcagtttgccgcttggaagtaaagtaaacgatgactggtccgcgcgcactcgtcactaaatgttgcaaggtcgcgcgtttactagcttcatcattgacctgttcgactgctaagtaaatattaggacgattaaccgaatataagacttgctgggcatctggaacggttaattgtgtcaaaatatcttgtcgaacgcgttgtgtagccgttgccgtgagcattagcgttgtcggtgtctgtaaccgttgtcgaatttgaccaaggcgacggtagtcagggcgaaaatctggtccccaagttgaaatgcagtgggcctcgtcgataactaataacgccagttgcacttgcatcagcgctgtttgaataatgtcttgacccaacatttccggcgaaatgaacaagaatttaagctgccctaaatgattcagcagatactggcgagcaccataatctagttgggaggtcaaagcagcaacttgcttttcgccttgatagtttaagcgcgccacctgatcttgcatcaaagaaatcagcggtgaaaccaccacaactagcccgggcagtgcggtcccgacgagttgatagatcaatgatttgccggtcccagttggtaacactgccaagacatcttgacctgctaataatttctgaatgacggctagctgcccggggcgaaattcatcgaagccatatttcgttttcaacagctcatataattcatcttctgacatgctgacacctcataatctgaaatagccgaaattcaaaaaaatctagcgtgggtagcgcagcttgggcctcttggaatgaccagtttgcaatgtcggactgggctgcaaagatggtggccaactgctgagttaattcatgattcaacaccatttcaaacggaaaatcaggcgaccaaatcgccacctccaacaagtgctcccgtaccgtactcatctttaagtgccgcgtctgcgcaattgctgcaagttgctgggtcttcaagaaagcttggtaagtttgctcagcgctttgactgatggcactcgcttgagtgagcactgacaacaactgggaaaatggatcacgcgggtgtcgctgaatccaagcaatccattggcatatcacgtccgtgtgcatcaagctagcctcccagggttgtcgacctaattgtgccgctaattgctcattagtcaggcccggttcttgataccccgttataccttgaacaaacaccgttggcaactctgggtctgccaaactcgtcaagaaggcagtcaaggccgcatgaatttgctcgccaagttccaccttcgactgctgacgtaaccattgtttgacctgggcttgaatccccggatcagtcgtcaccggataataatggcgattatgatgtacgagttcggaaacgacttgtagggctagctgactgacgattctaaatcggcggacatcagtggtttgaaacacttcaaaattttggggcatgtataaagtctgccggagtttggcttgccgttgttcccccgcctgcgttagttgccagcatcctgtggccgtactcgtcaattgaccgttttcagtcaaagccgcagttgctgccatgaaatcttccaagggaacctcgtggcaactgtcgagcaaatccaagtagccggcagttaaccccgcaaaaagcgtggagaccgtacggcggccgcgcaagacattgaatagaccctttgctcgtcgcggcgtcgtactgaataacaataaaacgtagtctgtaaacacgctaaggcctcccttaagtcttgctgttgtgattgttaattgcgcactaaatgtgccagtttttaaattaagtcgtgatcagcccaaatttacgtgcgtcagtgtcgctgacagtgacccgcgacacagcatagcggccgacagctttttaatctttctaagccttgatccaagcttcaaattcatcaacttactgccacattaaagctcatggataaccatccgccaaccggcagtgtgcgtctttaagaatatcacggtggcaccaatataaaaaggcagtcaccctgcagttacgcaattagtgaccacccacattattttaacgacttagattaaattcggctcataagctgattatggttgcctaaccacttagctaatcgctgatagaccagccagaagacgttacccactagcaatcccttgatcaagttaaatggaatgactgccactaacaccactgtattcagcgacatgctgagattcatacccattacttgcaaatagaatggcaaaacaaacgttaagttagccaacgattcaatcaccaccaggccgattgtggcgaccacaatcgccacaggcatccgccacttgggattgccccgatagtaacgaagtactaatgcaaatgctaaaatcaatactgccgtacctaaaaaactagcaaaagaaccgattaagtcatagatggcaaagcccatcatggctgaatgtaggagcagtttgatgatagtgatgacaaacgcgcccccgacaccaaagagaaagagaccaatcagaattgggatatctgaaaaatcaatcttcatccatggcgctaccggtaaaatcggaaactccagtaacattaaaatatacgcaatggcaccgagtaaggctatgcccactagtcggtgtaacgttgtatgttgcataacgcaccctcctatgggtcatcttcaatgaaccgcattaccatttgttcaactaaaaaagtccgcccgatcacactaactgtcatctgggggcggacttacttgcaacgcttggcaaataagctcgatcttctttataccagactttactgtcgactttggaattgcaccaaatcactatgcacacgcataggtcgcgggttattaccgccggtcgggaatcacaccctgccctgaagatgaaccaatatttatttttacaaattcattttaacggctttcgttcaaaaatgcaagcgctatcgttcaccttttaacttactaatttcaatcggcttcaatttacggtattcgcccggttgtaagctttgcaaatcgagaaccccataacgttcacgtttcaacttagtcactgggtgacccactgcagccaacatctttttcacttggtggttatgaccctcgtgaatcgttagttggaccagcgcattattcttcttgtgatcactatctaacaagttcgacttcgctggagctgtcttacggccatcgatttcaacacccaagcgcaattgcttgagatcagcattggttggtaccccttcaactttggccaaataagtttttttgacttcgtacttcggatgagttagccgattagcgagagccccatcatttgtcatgatcaacaaacctgaagtatcgtaatccaaacgtcccaccggatagattcgttccggtacgtcttcaaagaagtctaataccgttttacggcccttctcatcatgaacagttgtaacgaccccccgcggcttataaaataaataatacacgagtttttctgcattcaatggcacgccatcaacctcgacatggtcactaggctcaacctttacaccgagcgtggtgaccgtcttcccattcaccttaacgtgaccagacgtgatcaacacttctgatttacgccgcgaagcgatgcccgcttccgccattaccttttgtaatcgttctgccattattcatcctcacgttctgcttgtaatttatcctgaaatgcatttaaaaagaggtctgtctctggtgccggatgctcagcatcacttaaagcagctaggtcaatcgctggtaagtcatccaaagactttagtccaaaataatctaagaacagttccgtcgttccgtataaaattggtcgtcctggctcacttaaacgccccgtctcggtaactagttgtcgcaaaaccagcttttgaatcgttgacccactgtgtacgccacgaatctcatcaatttcaatccgcgtcaagggttgccgatacgcaatgattgctaacacttccaacgatgcttgcgacaaactcgtggtgagtggtgcttcaaagtagcgctttaacaccggtgccaccgcggccttagttgctaaccggtaagtattcgccgttgataagatcattaaggcactgtctgggtcggcttgatacttcgtggccagttgtgtgagcatcgttgtaatcgccggcttagcaaaccccgtggcgtgctcgatttcggcgaccgtgatgccctcatcgccagccacaaataatagtccttcaatttgttcaatgttcgtcatgctgttcatcctgtcgtaaatataaatgaatcggactcagtggctcagcttgctgcagcgccacttgatcctgcttggttaattctaacacagccatcaaggttgtcactaacatttcatcgctggcactaaccgtaaataggtcggcaaaatccagtccttgtggttgatgttgcaattgcgtcgtaatttgtgtcatccgctcatcaatgttgatggtttcagccacaaccgttttcgttagtggccgtacccgccgccgtttagccactaattgccgaaaagccgtttgcagatcatctaatgtaatccccgcagtcagcttgggcgcactcagatcagctggtactaacatcgcttcacgcgtaaaatgttgatggcgcgcctgttctttttctcgcaattcaccagcggcttcctgataaaccttgtaagccaacagttcagctacaagtgagtcacgaggatcatcgtcctcattatcttcgtccatctcgtctggttcaggctgtggcaataagaaacggctcttgatcgtcatcaaagtcgcagccataaccaaataatcaccagcaatatctaattttagcgctcgcatagagtgtaagtaatccaaatactgctgcgtaattgccgcaattggaatgtcataaatatccatcttgttttggcgaatgaggtgcaacagcaagtcgagtggcccctcaaactccgaaatcttaatggtgattggttgttgttggttgtttgtcacgattacgctcccacgcgccaatgatcggcgccatttctaaagttcccatgacccgttgtttgggatataacgcggccaactcatccaacatttgatactgattggccgccgtccgttcctcgggtgataatgaatcgtgatgcagtagaataaagtcactgccgacttcaatgccgataataccacagaaatcgccgtcaccttgccgccatagtaatagttggtggtcttccgttgactgataccactgcatctcagtttgtagatgaattaagtccttaaaatctggaataaatgacagtagccccattgctaccttttcataatccttccgatatttaacgagcacggtattgcctcccttgactgcttgattctgcaccgcatctatgcccgcggatgatatttattataaacctcagctaggcgttttttcgaaatatgcgtataaatttgagtcgtcgaaatatcggcatgacctaaaagctcctgaacgacacgcaagtccgcaccattttctaagatgtgagtcgcaaacgagtggcgcaacgtatgcggcgtcacgtttttttcgatgccagccgccttgacttctgccttcagatttttccaaaccccttgccgacttaatttaccaccgtgattattaataaacaaatagctattccggcgtttggcagagacgagtttgggccgagccgtttttaaataacgggtaataaaatcaatggcaacatcaccgataggaatgatccgctctttatcacccttaccgattgtttgaatcaaccccaagtctaagtgcagatcatccatcgttaaattaattgtctcgctgactcgcagaccggtcgcatacatcacttctaacagagttcggtctcgtaatcctaacggggtattcaacttaggcaccgctagcaaccgttcgacctcgcgtggtgacaatacttgcggtaaatgctgcgcccgcttaggcgtgtcgatttttagcatcggatcagtatcgatagcgtgcatctgtgctaaatattgaaaaaacttacgtaaactagaaacactgtgaatgattgtatttcgcgatttaccagcctcatctagatactgtaaataattcaataggacgtaccgatcaaccacccgatagtccgtgatttgctgactcatcaagtattcgctaaacgtagtcaggtcctgagaataactcttaatcgtattctcaactaacccccgttcaacacgcaaaaaatgcaggtaatcagcaagctggtcctgcattttttgatcaatcgtcggcttgctcatccgcattttccagtaacttgatctcgcctggttgttgactgatcaagcgttgcttcaagagattacccacagcgcgcttaaattgtgatttgctgataccaaagtaattccgaatatcatcgggatcactcttatcccaaaatggtagcgcgtggtcagcttgatgttgcaatgctgctaataacatttgggcatcatcgccaatctcttcgtatccccgcggcttcaaggacaaattcaattcaccatcgcgcaagaaaccaatgacccgcgccttgacgtgttgccccatgcgtggttcctgttcacgttctgacggatgaacaaagcccagatgattgtcatctgtaataaccgacgtaccggccatcttcaaacgaaaaacggtcgccatggtatccgtattcttaacttgagcccgatcatatggcttggcaattgcttcaaaatccgtcaattctgccagagtcgcccatagccgttgtttattgtcacgggctaacttaacgtataaacggtcatcttttttaggccatagtcgactgatggtcggtaattcgtctaatgacaccaccaagtccttattcggtaacccaacatcgacaaagacacctagatcatgccgcgtccggacaaccgttccccatacaaagtgatcaaacgaaatttccgggacgaaccgcgtcatctgcagatgatgatcttcattctcataaacaaaaccttcgtaaagcccgccaatgtgcaatggcttctctggttcagttttatcgacccacaacgtctgtccatcaatctgtacgaagtatgcttcatcgttttcatcggttaccttcgccgtaaccactgttccaataatactatccatgtgataactcctctaatatatccgtctataaatatcaacggatggttcttttaaattactgtaagctcaaatgtaagacttgaataatgcaatacgttataccagccgcaataattggcccggccgcgattcccttgagcaaaacaacacccataatggtcccgaatactaatgccacggtaatctctggtgtcgctgacaaaagcccgacaccgtgaaatgagagcactgaaaccaacactccacacgcaaccgcaatccagccaactggcgacttaaacgcatgccaaaggtcccgaaatccaatctgaccagtcgcaatcggaatcaaaattgcgacggtaatcaccgtcacaccccaattgatccccttctgaccaatcgtcgtcagcaatttactcgtattaggaatcaatttgataagcaacacaaccacggtcgcaatttgtaaggactgattttttcctaaccatgccaccactaaaatcgctaataaaaataaccaactttccatacgacacctcacgtgttatcaattgtaactgaaaatggcccgaattacgaggggtgttggtcgttactcaccaatttcactatccccccctgatcaataaccgattcctgttctttaatttaggcgggaacaaggttaaaaggtgccaaatcgtttggattccagctcgtcagcaaggttcgtcctattccgacttacggggccgggtgacaattgccggaacgtagccgacgtcgatttgagctcacgcagcaacccactgcgcaatctcaaatacgagtcttattctaggccggaagcaacccacttccagccaagaataatttggctactgagcattgtcacccaacccctccagtcggtaagccagtcgaatggctgatgaacgaccacctaacttggtgcaacttgtcgctgaacgggtttactacttagaattttgaacatgcgttaatgctgtctcaattgttttggacacctcagtactaatacggtggaattagaaataatcgtacaatcacaattatattatcaaactaactgttgtatgataaaatcgctgttttaaaatagcaacatctaattcgttcaatgctgggtccactcatgtcagccattcgaataccatcccgactggaaggcgtttcggccaatgctcagcggtgaaattccacttagcaagcgtttttggcttggttagtggaagaccagtatttaagacgtgattttcggcttaaatctgtgtccaccgcgttccagcaattggccgagatgcctggaagtcggtgtaggacgcagctagctaagcaaatttccgctaagtagatctttttccagcgggcttaagctggatcatttgacgttgacgatttggcaccttttaaccatgtttcatactaatttaactgggagtgaagcactttatgtaatataaaaagccgccgcaaagcgacgacttttcaatatcaaattagatttgatcttaaagggcgtttgaagcaccgcggtatacaaggccacgacgtgaatcaactgtgatcaattgaccatcagcaataacactagtagcgtccttaacaccaacgataacaggaattcccattgagataccaacaacagcagcgtgtgaagttaaaccaccgttttcaacaactaaagcactagacttttcgattgctggtaagtagtctttgtcagtcgtcttagtaactaagacgccaccttcaacggccttgtcgatagcttcttgagcagacgttgcgattacggctttaccgataaccgtttcatcaccgacaccttgaccatcagctaacttagaaccaattaattggatcttcatgatgttagtcgtaccgcgttcgccaactggcacaccggcagtgatcaagattaagtcgccttccttggcaaagccaagttcaacagccttagaagcagctaaatcaaacatgtcatcagtggtttctggtttttcagccacgattggttgaacaccccagttaaccattaagccacgttgagtccgttcgtcaaaagtgattgctaagatatcagcatttggacggtacttcgaaatcatcttagcagtgtagccagattcagtcgcagcaacaatcgtcttaatgttcaagttcttagctgcccgagcaatcgcaataccgattgtttcagtaacactagtcttgtcgaaacggtttaattgtaacgtaccgttttcagccaaagtgttttcagccttttcgtcaatcttagccatcatggcaacagattcaacagggtaaagaccgttagcactttcaccagaaagcatcgttgcgtcagtaccatcaaagacagcgttggcaacgtcagaagcttcggcacgagtaggacgtgggttttcttgcattgagtctaacatttgagtagccgtgataacaggcatacctaaagcattacacttcttgattaaactcttttgtaccaatggcacattttcagcaggaatttcaacacccatgtcaccacgagcaaccatcaaaccatcacaaaccttaagaatttcatcggcgttgtcgataccttcttgtgactcgattttagggaagatttgaacgtgttccatgtgcttttcttcaagtaattcacgaatgtctaagacatcttgtggcttacgaacgaatgaagcagcgatgtagttgatttcatgatccaaaccaaagcgaatatcacttgagtctttttcagtgatcccaggtaagttgattgaaacgccaggagcgttaacacccttacgtgagcctaaaacgccggcgttttgaacagttgtaaccaattcgcggttagcttcgtccttttcgtcgatcttcatatctaataaaccatcatcaaagaggacatggccacctacatgaacatcatcatagaggttcttgtaagtaacggcaatcttatcgtgggtcgtatctaatgaatcatccatggtgatacgaaccttgtcaccgatcttgtattcagattttccgttagcttgaacggtcgtccgaatttcagcacccttagtatcaagcatgataccaacggtcttacccgtaatcttttctgcttcgtgaactttgtttaagcgatctaaatgttcttcatgatcaccatgtgaaaagttaaagcggaaaatatttgcgccggcttcgattaatttaacaatagtgtcagtatcggtgctggcaggaccaagtgttgaaacaatcttggtttttttcataagaaaaatctctcccttgaaagtttttataaaaagacattaacgtcatttttatcaaattaaaataagaactaacatgccatgattacttgaatgaaatttcttcattcaacttatctaatgacacttcaacgtcatgcttagattcaaataaatctaagatgttgtggttgactaattggttgttttgaattccaaccgctaagccacccttgccggcaagcaagagttccacagcgtaggcacccatcttgctggccatgacacggtctttagcagttggattcccaccacgttgcatatgagcaatggtattcccacgagcatcaaagtcaccatattcggataacttctcaacaaactcctgggcacccatcacaccttcggctaacacgatcaagttgctccgatgaccattggcccggttatgcttaatcttgttggcgatttcttccatgtcccaatcaacttcggggaccacaatagcagtcgcgccgattgaaacaccggaccataaggctacgtcaccagcgccacgacccataacttccacaacgaaagtacggtcatgactatgagccgtatcataaatccggtcaagggcttgcacgttggtgttgacagcagtgtcaaaaccaattgtgaagtccgtgtaaggaatatcattatcgatcgtccctggaagaccaatcgtgttgtagccgtgttccgttaagcgcaatgcgccatggtaagaaccgtcgccaccgataacaactaaagcatcaatcccaaaccgcttcaattgttcgatcccttttaattgaccttcttcatgggcaaattctggataacgtgcggagtatagtaaagttccgccgcgttgaatcacaccatctaagtcggctgcttctattttgtgaatgtcaccggcaactaatccagcaaagccgtaattgatgccgtatgcttccaacccttcagccattgctttaccagcaactgcacgaacggccgcattcataccaggagcgtcgccgccactggttaaaataccaatgcgtttcattttttcacctcaggcaataaattgagttcgtaactccataagtgattctaacacttttcacgtggattgtctgttattttctaaaattaaatgcgttaaaaaacgccgtcgtatcaagggatagcgttcttcatcaccacattatcgcgacctaataaggttgtaagcgctccaaccaaatctggattttctgcgacccaatactgtgaatttagttcaaccgttcgatgtgctgctaccgagtaaattagaactggattaggacctcgatattgacttaagatccttaaaatttccttttgcacagtcgccgttgcttgctcaggttgcaaccgcaaaaagagttggccggttggtttgggtaattgttccgccaactgccaggtgtttacgatcacttgcaaatcccgctgttgctcgaccttaccagtaattaacacgattgcttctggtttcaattccgcctgaatccgttgataggtgttgggaaaaatcgtcaagtcaatttcgccggacaaatcacttcccgttgcaaatgccattggttgaccacgtttggtccgaatcgttcggaccttagtaatatagaccagtatttgtgccggttgttcactcgtgagcgtgctgactaattgcgtatgtcgttgttgcgcgagccaatcatacgtttccacagggtgccctgaaacgtacacaccaagatactccgcttctttggccaatcgctcacctaacgaaagctccggctgttttttgatcttaggggctaatgattcaaataaactcatactgccaccggctaactcggcacttgacatcaattcaggcacactggtcagtagctctgcacggttcaaaccaaagtggtcaaaagcccccgcatagatcagtgcatccatcaaatcggctttgagccacttcgcgtcaatccgttgcatgaactgctgaagacttttaaacggtccgttcgcctgccgctcgtctaacacactcgcaataaagtcacggcgcaaccctttgattgaactgagtccaaacacaatggcttgaccattccaatcaaagtattgaccgctccgattaatatccgggggaataatcgccacttggtgctgacgagcttccgctagatactgtttcagcttcgttccattgcccaacacagaattcatcaatgaggtaaagaacgctccggaataatggactttcaagtaagcaagttcaaaagccatcttactgtaggcaatcgcgtgtgagcggttgaaaccatagttcgcaaattgttcaatatattgataaacctgtgtcgcaactgcttcggaataaccattctgttgtgcaccagcgataaattgttgccgcattttatcaatcacagcacgttttttcttgctcatcgcccgccgcaataagtcggcttcacctagtgtaaaaccgcccatgaccgcggcgacttgcatgacttgttcttgatagaccagaataccgtacgttggtcctaagatgggcgcaagttgttccgccggataactgaccggttcttggccttgtttgcgggcaataaaatggtcgatattttccatgggccccggccggtaaagtgcattgaccgcggcgaccaattcaaagttatccgggtgcagacgccgtaacacgtttcgaattcccgccgattcaaattggaagactccggtcgtgtcgcccgcctgaaataatttcagggtcgctggatcgttcaaatcgattttagtaatagccagtggcttgccagtttgacgctgcacataatgtagcgcactagccatcaaagacaaattccgtaatcctaagaaatccatctttaacaaaccaaccgcttcaacagtgtccttagtatactgggtcatcatcatagtttcactacctgcttgtagtggtacgatctgaattaatggcttttggcttaataccaccccagccgcgtgtgttgaataatgtcgtggcaacccttccaaacggcgagctgtttcaaataataatttatttttagatgaatcagcaacgaggttttgtaaccgttgtgagccctggtaggcctggtcaagtgtaatatgcaattggtttgggattgcggcactccagtcactcatctcgtaagttgagaggccaaacacacggccaacatcgcgcagtgcttgctttgctgccaaggtcccaaacgtaatgatttgtgcgacgcggtcatgaccatacttatcatgaacataattaagtacctgttcacggcgattgtctggaatatccaagtcaatatctggcatattcgcccgtttagcgttcaagaaacgttcaaatagcaagtcatattttaagggatcgacatccgtaatattgagtgcataagcaactaatgagcctgctgcagaacctcgcccagggccagttgtaatctgggcctcatgcgcaaaattcatgacatcccacacgatcaaaaagtaatcatcaaagcccatctgatcgatcacggtcagttcgtgatccaaacggtcctggtaagcctgctgatcaaccgacggcgttattgccgccaatcgctccgttagaccagccgtgcataactgccgtaaataaacgttcgctggttgtccagcgggcgttggaaattgcggcaactgtggctgttgaaattgtaattcaacttgacactgtgccgcaatttcggccgtagccgccaccgccgtcgtcaatcccagttgctcatagtcagccgttacggtgttggccggccgtaagtagtgactgccttcgataccttgtaacgattcgggctgttcgatctgttggccccgatcgattgctcgcaaaactgaaacggcaaagtaatcctttgcttggacatagtcgactggatctaacgcaactaccggcaattgatgctgttgcgcaaaggccgtcattgttgttcgcaatgcaggggcctgatccaaagaaatccctaagtaaaggctagcagagtcgaccgcctgcctcagcgtggtaatccaatcagcagctcgctcagcggtgttttgtaacaacagcgcagctagttcactgtctttagccggggttaagaccattaaatggttcaaataaggtaatacggctgttagcgacaatcctgcatccgtcgccgtctgcttcatcgtcgacaaccgcatcaagttttgatagccagcttgatctttcgcaagcacgaccagactaaacgtttgcgccgttagttcacgtcctaataagttcaatgttattcccaatatcggggtaatttctgcctggcgacaggcattataaaaatcaacaataccgtacatgatatcaacgtctgttaaagccaacgtggaatacccctgttgcttggcagtttggactagctcactaactgtactagtgctgtgaagtaaactaaaagtactcaatacttgcaatggaacatattgcgccactatcgtcgccccctttcataaaatatcagctttcaactcgcatcgaaaacgtaacatccgatcagctacgtcaagcccgctcccaattgatgggtaaacaaagaatttaccagtctattcaatgccagttgatgaccaatcttgtcctcagatatattcgttactattcattataccaaacagttgttctaagcggcagttttaagtcatcagataacgtgcacggttatgtttactagggtttcaccgccgtctcgtcgtaattatatcagcctaattaaagccttaatatcccgttattacctaattgctttttcctgtcggtgtgttaaaataattttcattgggaggtgtcggaaaatgatgagacaacttacgattatcttttggagtgtcctcttcggtgaagtcatcggctatatcggtggtgccctcgaacaactctcctataatcctggtgaaattggcatcgttgccgcaatttttgcgctaatcgtggtcaacagcatcacttatattactaatcattcccaacccgctaaaggttcagataataagtaattaaaaacaaccagaggctttgcttcgcttagtctcagcacaacaaaaaaagacgagtatcccgattgcggttactcgtctttttttgttgtgtgcttgacgcgccagccaactagaatgctggtacatacccgaccctaacattcagattaatgacgcttacgatccatcacttgctttgagcatttgcagcattttggcatatttctgctttgcgcgttgtgctgctgcccaaaatgccaaatcggccgctgataaagaaccacgttgtacattaatttttcgattcattttttgcatactggtcaaaccttttacgatcgtcgtccatgttcgcttactcctcgattttggagtagcttaacacgacagcgtcggcggtaacaactcttttctcagtatgaggttaaacgcacgggcgcaaggtccccctcgtccgaagctaagcgcggctaccatcatcataaaccaaagatagctgcctcacacctacacgatcaagccatccagaatcataggctcaaccaagtcacaataataatccgcctaaaaaaagctggaccgtgagcatcgcaaggtgctcacggtccagctttttattggcccaattatcgtcactgaaacgcattatcacgcgttcaaatcagtgattacgcttatgccggctgggtcgattggttttcgaagactaagtgatcgtccatcaaattaatggcgactgtcgattttggtgccacgcgccccgcaatgatctcttttgccagcggtgtttcgacgtgattcgtgataaagcgccggagcggccgggcaccgtatgccggttcatacccctgcttagcaatccacttcttcgcttcgtcagaaattttcagtgtaatctcacgatcttggagacgggcagacaaccgatcaatcaatttcaccacaatttcctcaatcgcgcccaactgtagtggcgtgaacataatgatgtcatcgattcggttcaaaaattccggtttgaatcgactttgaaccagctgcataacctgttgatgggtatcggccgacaagtgaccctggtcatcaacccccgccagtagcaactctgatcctaagttcgacgtcataatcaagatggtatttttgaagtcgacggtccgtccttgaccatccgtcaaccgaccgtcatccaatacttgtaacaagatgttaaacacatctggatgcgccttttcaatttcatcgaataacacgatcgagtacggattacgccggacagcttcggtcaactgaccgccttcttcgtaaccaacgtagcccggtgccgccccgaccaatcgcgaaacggactctttctccatatattcactcatatcgatccgaaccatatgatcatcggcgtcaaacaaattctcagccaatgctttcgctaattccgtcttaccaaccccagttgggcctaaaaacataaaagaacccaggggacgattaggatcttgcaaaccggcccgcgaacgtaatacggcatccgaaacggcatcgaccgccgcatcctgaccaaccactcgttcatgcaaatggtccgccaagtgtaataatttctcccgctcaccggcaaccagtttggctactgggattcctgtcatccgggaaaccacgtttgcaatctgatctggcgtgacggattcctcaactaaccaatcttcatgatgatcattggcttccatggccttcaactcttgttccagctttggaatcgtcccgtgctgcaacttagctgcttgttccagatcataattattttcagcattttccaagtcgtgcttagctttgtctaacgccgactttttgtcgcttaacgcttggagactcttcttttcactgtcccagcgttcggataaagcccgctgtttttcctttgcgctggcgagttctttttgtacatccgctagccgtttaacggaggcatcgtcagtttccttctttaaggcggcttcctcgacctctaaacgcattaattgtcggttgacttggtctaattccgttgggttggagttcatttcgacccgaatttcagcagaagcctcatctactaaatctaaggccttatctggcaagtaacgatccgtaatataacgatcagataacttggcagcggccactaaggcgttatcatgaatccgaacaccatgatggatttcaaagcgttcctttaagccacgtaaaatactaattgtatcttcaacactcggttcagcaaccaatactttttggaaccgccgctcgagcgccttgtccttttccatgtactgacgatattcatctaacgtcgtggccccaatcaaatgaagttctccccgcgccaacattggtttcaacaagttaccggcgtccatactgccttctgtcttaccagcaccaacgatattatggatttcatcgatgaacatgatgatctgcccatcgctcttcttgatttccttgaggacggctttgagtcgttcttcaaattcaccacgatacttcgccccggcaatcagggaccccatatctagcgagaacaacgtcttatcttttaagttctccggcacatcaccacgaacaattcgttgcgctaggccttccacgatggccgttttcccaactcccggttcaccaatcaagacaggattatttttcgtctttcgtgacaagatccgaataacatccagaatctcttcgtcccggccaattactggatcttgattcccctggcgcgcctgcttaaccaagtcgacgccgtacttttccaaagcttgatactgatcttcctgattacgtgacgttacccgttgacccccgcgaatacgatcaacggcattcttgacttgtcctgccgtgatgccttgctgattcaagtatttggtcaactgatcaccagtttgatccatcagcgctaaagccaaagtgtcggtcgcaaggtaatcatcacctaacgctttgcgcttagcatcggcagcctgcatcagcgtagctagactactgctcatactgccaccgtactgaacgttaccaccgctaacaacggcaatatcatccagctcacggtcgagctctgtttgtaatcggtctaaatcagcgccggcctcactaaagatctgccgaaccagttcgcctggttgcgttaaaaatttaaatagatggggcaccccaatttcttgatggcgccgtgtttgtgcgatttgttgtgcctgttgtaaggcttgttgtaaactttctgtaaattgttctggattcatatttacgtacctcctcaaaaacggtagcaaaaaggcagccgtcatagctgccaattttcgtttgacctttattgactattagagtataacccataaggtcaaacaaggtcaaggatttagtcctggtcataattatcctgaacgatttgtaagacaacgtccacggcttgggccatcacttgttctgaaacgtattcaaaccgaccgtgcatgttctcaccaccagcaaacaagtttggtgtcggcaaacccataaatgagatcttggagccatccgtcccaccacgaaccggataaatggctggcgtgataccgagcttgagcatggcttgtttggccaattcaacgacccgcatatctttttcaatgatttcgcgcatattgtaatactggtccttcatgtcgaccttgatccgggccacaccgtcagccaaattcagccgatccgcaaccgccataaataaccgtttacgtgcttcgaacttatcgcggtcatgatcacgaataatgtaagtcatcttagcgctgtcaacggtcccgtctaaactaagcaagaagaagaacccttcacggccttccgtgtgttccgggacatcatgtgcgggtaacgccgattgaaaatcaacggctaactgcaaggcgttgaccatcttatccttagcttcccctggatgaacgttgacacctgtaatcgtcaccgtcgcttgggccgcgttgaacgtttcatactccagttcaccaagcggaccaccatcgacggtgtaggcataatcggcgccaaaggcaggcacattaaagtgatcagcaccagtcccaatttcttcatcgggaccaaaagctaaccgaatcttgccatgtttgatctcaggatgggccaacaaatattccgcagcactaatgatttcagcaacaccagacttatcatcagctccaagcagcgtggttccatcagttgtgatcagcgtgtgaccagcatagttctttaagtttgggaagaccgccggatccagcacatagtccccgtttccgagcttaataactgattcaccgtcataattgtcaacaatttgtggattgacattttccgcgttaaagtcagccgtatcaatatgtgaaataaagccaagggttttaacagctttgtcactattcgcaggaatcgtcgcaaaaacgtacgcactttgcgcatcctgttcaacatcgctcaagcctaaatcagtgagcttactcattaattgctttaaaaaggccgtttcacgtggtgacgaaggaattgtcgttgattcctcatctgaacgactattaattttgacaaaggttaaaaaatctgaaattaagtttggatattttgacatatgataacttcctttccttattaaagttcatgattaacttagatgaaggtaaacggatcagtattcagctgagacgccacaatctcgattggccagccagcttgtacacgccattgatcaaacagcttagtgagttgtgacttacaaatactctcgatatggtggcctggatcaatgaccgtcaacccggctgccagcatatcgtgaccggtgtgataatagacatccccggtcacgtaagcttgtgcacctgcttgcaacgcttggggatagaacttaccaccatcgccgcccaggacggccacacgggtaatccgttgtcggggatcggcactgactagtcgcaggccgctgacaccaaatacttgcttacactgttcggcaaacgcctgcgctgataacggtgtcggcaaatcaccgactcggcccatataatactgatgaccgccagacaacagtggcacgacctggtaatcccacgtgtcagcggctaagtcattaatgcccgctaccgcagttggaatctgatcggctagtaagtcgacgctgaactgttcacccgagttgacagcgtaacgatctagcgtggcacccacggtattcgttaagtattcctgtaccgtttcaacttgattggtcggtaccgttaaagtcaacttaacagcctgtgcccgatacccaggaaccaacccctgcacattttgcaagtctagggccgccgccagccaatcgttcatgccgccctcagcacagtccagattcgtatgggccgcgtacaccaagatgtggtgagctgcaagttctgcatacattgctttctgaggatcctgataatcaagattgttagccggtcgaaacatgacgggatgatgagcaaaaatcatgtcagcaccgatcgtgatggcttcttggacaacttccggccgcacatccagggtaactaacaccttgtggatgtcctgatgaggatcgccgatttgtaatccggtgggatcatgctcccacttcaacttgagtggcgcaaatttttcaaaacgcgcaattaattcacttgcttgcatccgtcaagactccttcaatcaatttgattttagcgtgagccagcgctaactgttcctctggtatcactttagcccgttgcatttgcgcaaccgccgcatttactcgttgtaactcacgttgccacttagcgataaacaccggcgacttctcagctagcagaaacgggccaaacatctgttcagccgtcgtatacgtcacctgatgatcaacccgatcagcacaaagaatctcataagtatggccatcttcagctagaattcgttcagctacaatttgaaactgattggccgccagccattcccgcacggtcgcttcaccaacattaggctcgagtaccaaccgttgaacaccggcgagctgggtcggcccctgttcaagaatatggcgaatcaaagggccccccatcccggcaatcgtgaccgtatcaatacgatcagctggttcaatcgcagcaagaccgtcagctagacgggccactaagcgatccgttaaccccagtttttgaatctcatgacgcgcattttcaaagggcccccggacgacttcaccagctacaccataactaatttgatgatttaatgcgagattagctggcaaataagcgtgatctgacccaatatcggccacgcgggcgcccggctgaacgaaagcgccaaccgttgctaatcgttttgataattgttttgcatccacatacagttcccctttaattcgggaagatttacccacacgactaactttcagtggttgtggtcaaatccacccggttcaattgttttaattattcagtttaactaaccacgcacgtcactcgctatccttagtatgcaccaaaatcgaaacgtgctggtcgttgaattacgggtcggctctttatcagaaatacccaacgaggttcaactaagatcatggcgatacccaatggcctggaagttagcagtctgaacaaaggtcgcacactagattagacctttgttggccaatcatcttcgaccttaaagaccaacgcatttcaatggtgattcaggatagcacccgtatcaccgtacgttactaatcatattttaccatgcttcactgtgaatacgcattcagctggttaaattttcctgaaaattcctaagctttgttcaaactaactaaaattctattaatgcaagtttggatgacaggcagacatgccataatatggctaatgtcgactggcaagcgacatattatttaatgagagaaagtttgattaaccatgcgaaaacgtcttttaacgacgtcgccatttttgactggcctaaaattattagctattctgccgccggtaggtatcggatggctgatttatttaagccggtggcaatggctggcgttactcaaacatccacgacaattcagtcggcacgacccgttgctaggttttatcgtcctattaatgggcatcacgacgctcaatctcaatcaccacgattatcgtagtgttattctgtctgtcttaatgctttttgtattgggcaatctttggttgttgtgtcgtgagtccacgcagtcgattgcttggcacgagcttcgtaaatttatcatccaatttggcttgtatattacaattagtggttttgctttccactggcttaaccaagtattgacattaccaacgtggctgaagttcatgctgggtgacctattatggggctatgctgctaatcagaatcgcttgttcgggtccgcctataatccaaatgatgcctgctgtttattattgattgccctcggcttactattgacacagttaagtcatggaagcgttcaccccttcacgcgctggccgctcataaactggtttttggttggcttactttgtgtgggcatttatcaaaccaaatcgcgcacagggctcatgatcatgatagccattctgatcatgacgacttaccagctttgccgtcaccatcgcattttggttacaacaatattgattgctggcagtttagttgtctggcacgttttccccagaagtgcttcgaccatcaccgcgcttcaaagtcgcttgacgatttggcacaacagcttcaccgttttcaaacaagccccgtacctcggcgtgacgtattttggctttgcccggcactatttgcaattgacgggaacctacgtcccacacgcccacgatattttgctcatgctactagcttcttttggtatcctaggcggtgccggctttatttacttagtcctcagcagtggctggcacttaaccaaatattggcaccagtatcgtacgccaaatttgcgttactttatgatgactttgcccatcattctagcctatggattgacggacttcgttttatcttctatgcaagtattgattattattttgctcattatcgcttgttggcaccacgaacaacaattgcggccaatcattagccctcgcaagtatcagtctccacttatctgacacttttcatcgccatcaatttcgaacgggcagtaatgccccatttcaaaaatagtgtgcgctgtcggtcatcaagccgcaacacacactatttttagcgtaccgttaaccaaatcggcgatatgccaacacagttaacggcataaaaatcacaataataaggaaaccacttaacagtacaccaaatgcatcgggcccccaatggccagtccgcaaaattgtgcgcatcgcggtaattgttagactgaccggattcaatcgaacaattgtttgcaacaaatgtggtaacgtcttagtcggaataaaggcgttagataaaaaggtcagcactaaaataatgatcattgacaggctgccaatcagggccgcatttttgaccattaaaccaactaaagcaaagacccatgaaagcgaccatccaacaaatactgccagcagtaaaacgccgatcaatactagtggactaacaatgggtcgccagcccatcataaaagctgtcaccagtgccatcaaaccagaaataagcaatcggaaaacatcccccactaactgaccggctaacggtacgatcggtgaaatcggtagcgtcttgaagcggtcaaacacccccgcgttaatgtcttcacgtaattgctgtccggatcccgatgctgcattcaaaatactttgaatcaaaataccggtaactagcattggtaaataggcctggacactgcccgcaatggccccaccaaacaagtaaccgaataatagggtaaaaataattggttgtatcaccacgtcactaacattatctggattatgccacatttttaataagttccgatgcgtcattgtcaaaacatgacttaactctgctggttgtttgatttccatcgctttgacctcctctaatttgtgcccacggtcagtttaaaaaacacatcatcgagcgacggcgcgtgcatcgcaaagttagtgaccgtgatttgagcagcttgtaaccgcatcagaatttcagtgaccggcgtcaagttagcggtatccaacggcactgttagggtccgttccgcaacacggacatcttgaccgagcatgacttgtaagatatccttagccggtgggacggccgtcgtcgcactgacttccaattcaagctcttgaccccctactgtttgtttcaaagcggtgggtgtcccactggcaactaactggccatgatctatgagcgcaatgtggtcggctaactggtcagcttcctctaagtactgagtcgttagcaccacagtcgaaccatcggccactagttgacgaatcgcttgccacatctgcgctcttgtccgcggatccaagcccgtggtcggttcatcgagaaaaagaatggccggtttaccaatcaagctaaccgccaaatctaatcgtcgccgcattccgccagaaaatgtggtcaaaacgtgatccgcagactgcttcaaatcaaaatccgtcagtaattccatcgctcgatgcttcgccgccgcacggcttaaaccattcaaacgcccaaaaatctgcaagttttcccgcgcactcaggtcctgatcgatactagcggtttgaccggtcaaaccaaactgctggcgaacgcgtcgggcttgcgacaatgaatcaaagccattgactaagattttcccagcatcttgtcgcaatagggtcgtcatcatcctgatgaccgtcgttttacccgcaccattaggacccaataagccaaaaatttcaccccgttggacttgcagtgacaagtcttgaacggcgactttcgttccaaatcgcttctgaacatgggtcatttgaatcatcatttcttcatccaagttaaaacctcccgcaaattaatcaggtaccctgacgaaatatatattaaggccccctgactaaattgtcaacgattaattattgaccatcaatctaaaaatcaactaaccttaacgtaccgcataccaaagaatgttgtatacttaagaaaagaacgaatggaatgatcaatcgtgacaacgaatattaaggcggaactggtcgccggaaaattggccgagtacgaacaactaagcaaaatttatgatgacattgtcaagcaggcccgtccaagaataactgttgaaggtcagggcaagattctactagcactagccgatgaggaccacctctcacaaaaacagttggcaagtcgccttggcatgtcgccgcaatcaacgagcgagttcgtctataaacttgtcaatcgtcagctggtcactttatccaagtccaccaaagatcgccgcgtcaaccttgtgaacttaacggctgctggtcgcaaagagattgcatccgcagcccaggaggtccccccatttgtcaacacgctttctgacgacgagctcgatcaactggcacccttgttaaccaaaattaccaccgcgatgtatgcggatattgacgctgccaacccgactttgggcgttaagtttcacaaattatttgctagtcggtacttgaaacagtttaaaaagtaaatcatatgccacctgcccgtcatttttagatgacctcttgctccgaattaaccctgaatcagtatttggatctaaacaaacttaaaggcgaaccaattcagttacgaattggttcgcctttagtgattatttaacttttaacaggaatcatagtttaccatttataatcaattgggtcctgtaagccccggccagtcgctttgtccaacataatgcgttgttcaaagtgcgccacatttcgtttagtctccttgaccatatccggattgactgaaacatagtcgatgccgctttgaatcaggaagttagtaaactctgggtactctgatggtgcttgaccacaaatcgaaaccgtcttgccatctttatgggctgtcttaatcaggtgccgaatcgctcgtttaacggccaagttccgctcatcaaagaggtgagccaccgtatcattattacgatcacaacccagaatcaacattgcaaggtcattcgaaccgatcgaatagccatcaacgaattgattgaattggtcggccaaaataatgttggttgggatttcagccatcatatagactttgaagtcagcactccgagctaggccttcatcgcgcataatggtcgttactttttgtgcttcgtcaacggttcgtacgaatggaatcatgacatttaaattcttcaacccaaattcgttccgaactttcttgaccgcagccagttccaacttgaaggcctcgatatacttggaatcatagtaccgagatgcaccccgccaacccagtaaatcagctggttcatgcggctcgtattggtcgccaccctttagattacgatattcgctcgacttaaagtctgagaagcgtaggacgactggccgtggtgccattgcccgaacaaccttcgcgataccatccgccagcatattgaccaccttttcagggtgaccctgctcgatcaagtatagtggatgttcatgaataaaggttgtccataggaactcttcgcgcattaagccgattccatcagctggtaaacttgaatatttgtcagccaaatcaggatcacccaaattcatcatcacgcccgtagcagttggagcaaagctctcggccgcaaccacctgaccagcaaccgccgtagcaccactctttggcttcaacatgctagcgactttaccttgataaacaaccccgttcttagcatcgacggttacgacatcgccggtcttcaagacgtcggttgccgcgactttcttacttttagtgccgacaatacatggaatctgcatctcacgagaaacgatcgcagcgtgacaagtcatgccgccgttattagtcacgatcgctgcagctttcttcattgccggtacccaatctggtgatgtcattaacgtcactaacacttcgccttgcttgaactgatcaatgtctttcggattatcaatgacatgcacgactccactggctaagcccggactagctggtaacccccggacgataactttggcatccgcctcatccacaacatcttcatcgtcagctgcatctttgtgcttattacgctgtgaccaaactgtttctggccgcgcttgaacgatccatagccggttggtattcgtgtccaaagcgtattccatgtccatataacaaccgtaatgccgttcgatttctttagcgtagccggccaattcaatgacttgcgcatctgttaatactggctgaccctgtaattcatcggggacggactcttccttagtcccgccacccggtaaccgcattaattggacaggttgtttgataatattcttttcaacgattttcattgattgtttatcgataacaaagtgatccggcgtaactttgcccaacacaatatattcacccaaaccataaatggcatcgataacgatcttggaagcatccccatccgctacattgacggagaacatgatcccggaagccttagaaaagaccatcatttgaatcgccgctgagagggccactttttcgtgtggaaaatgctgtttgtgccgataatatgtcgcgcgatccgtgaacagtgacgagtaacattgttgaacccgattaacgacatcggcagcacctttaatatttaagtaagattcttgttggccggcaaatgaagcgttgggtaagtcttccgcagtcgctgaagagcgaatcgccacgaacggatcagtttgccccattttcttagcgagatccgcataggcttgttcaatatcagccgccagatctgcgggcattgtcgcattcacgatcaagttacgaatttgttcgcacgcagtatgcaattcatcagaattttcataatcctgaatgctggctaacaaatcattgaccttatcattcaatcccgtctgggtcatgaagtactgatacgcccgggcggtggttgcaaagccatatgggactggaacatccatcgatgacgtcatttcacctagtgaagacgacttaccgcccactaggttcacatcttcgcggtgtaattcatcaaaccataaaacgtttgccgtatcacgactactcataagattacctccctatgttcctgcacttgaatatcatcattatcaaacttaagttctgtaagcgtttacattaaccatttatattgtagttcatttttacacaaagtaaaacccattttcattattttatcggcaaaatatagttggtgatgttgactggttacgcccgttaaagttcaacacaggcttgaaagaaaagacatttaatggggacatgttttcaaatcaactcggattataatgataaactgtaaggccaactaattaacgaacttatttcacaatatacgaaatcaactcattgtggacgacgcaacccagtgtttatcacaaaaacgcaaagtagccagcggtgattactttcatcaccgctggctactttaagcgtctagcactacaactatgacttaagtctaaatcgatatttcactaatccgcaagcgtttcaactggtagttgcatccctttccagccttccagtgctcctgccaattcgtatgcttcaaaacctgcggatagtagcacgagtaacgccgtcttgcctagggttgttccccccgtccaatcgtacacgacataggtcttcgccggatccagttcaccaattttggttgccagatccttggcaggcatcgcgattgcacccttgatttgatctttcttcacttgggccggtgcattccgaacatctaagacgacgtacttgcccgtcgcattttgcatatcggctaaaacggtgtgatgatcgatgtataagcttaaatatgttgttaacaattcaattttcttgtcattcatgattaattgcctcactttttaattgttgggtgccttgcttgattttatccaataagcctttaaactgctgctgctcttgaaccgtaaacgacgcaaaaattgttgtaaccgccttaaaattggccggtaaaaattgcgtcaaaacactactaccggcggcggtcaaatgaatggcaaccgtccgcttatcatcttgtggatgctgcttttccacccagcctcgcttttgcaagccgaccagtaacttgctcacagtcgcccgagcagatcctagctttgtggctaactccgacggcaatagcgtgtgatcagtttcattttccagcaacattaaaataataaacttggattctgaaagttgatattgatcgagtaattgttcataggtggcttgcatggttcgaaatgtccactgaaaatccagaaaagccaacacctgctcagcatccgccgagctgctcgctttgcccagcgtcaattgcacacgctgtttatctggtcgatcacgaaacgaaaagtcaggcattgaaatccttctttctaaaattgattagccggctaactacttttagaagtatacacgctttttcatcatcgtcaacccttaaatcggactagctgttattcgaaacactcaccatccaaataaccctagccatcaagcaccacgacaattttcgtttaaactgatgcagattgaaatcaatagattagcgtgcgcgactcaacagaaaacaagcagtcagttgtgaaacctcccaacactcatgaaccctgcgcacaccaggtccagtacaattgacactcaccataatcgcatatgctatactgatgatcacgatacctattgatttggaggagtaccctaatgcacaaattagctattttggtgatgacaattggccttgcacttgctggttgtacgacccaaacattcgctccagcgcagcatcatcggtccgtcaaagtgacgacccaaaaagtgattcaagcaccaaccaaaacatggacttttgatcaagccgttagttccagccaaacaaaacacggcgtcgtcagcaatttagacatttccgtggttgacaaaactactgcccaatcaagctggaccactagtaacggccaatttttgtccgccggcgtcaaacatcgtcaagtttcgtacgccaaatggcaccatgatcagcaacgccatatcatgaaaagttaccgacaccggctgcatcacatgtcagttagtcaaatcaacgcggttttgaaaaagctcggtgcctcaatccagattaacaaactgactgacttaatttacttggaatccggcaatcacaccgatccgttaccagtcaacaccgcctttgctgctaaggggcaccacctctacgctgtcaacattcaatattcagatactgagcaggcaacgaccattgaacggggccgcactttcactgatactagtgccaaggcggcgcctaaacgcgtcaacgtagcgaatttgaatggtacctggattgctgccgaaactacgactagcgccagtgatacaggcaagttgctgatcaaagatggctacctatatcagcatcgttatgatagttatgaacgatctgctatccaggacctcagtcactattcattaggctcactgaatcaaaacgtgacctatgcggccttcaaaaccgatgcagcccacgctggctatcaattaacacataccgccgttgccagtggtgatagtaccggtatgttatatctcatcatcaacgctaataaaatcatccgtatcaatcagcagattgttacgacctatacgaaaaccagtgccgttgtcgctgctaacgacctaccgaaaacagacgttgatttatttaagcaaatggatcaaaaaaaagctggtgaagtcgccacgacgattacggtaaaggccggtcccgcgcaagttggcatgaccaatagtattaactatctaaccgaccccaatgctggtcaaattacagagacaatcgtggtcaactaacaaccaaacaaccaggcgcttcatttgaaaaattatcaggtagtcacttatcaaaaacgctacttcataaagcgcgcagcaaaagccctgttgacctaattcccacatcaaaataagcacgttgtaaaaccacactctggtgatttttacaacgtgcttattttgtcatcgaacatctgcacagcatcaataattttatgattaacacagtaacgcaatttcacgacacctcaagccgattcagaaagtggtctggtcaacttacatcccagtatgacacgacaattgtcccgctttaatcatgaagaatacgactaattacaaggttagcccctaatcatgctcgtattcacgtttaagtcgcatccatcctgcatgcagaccaaaagccgttgtaaaggacaataaccaggtcaaaccataacacagcgcaatgctcagccagggagccttgaccatcaaagtacgaccaaaaccacgccacaacaattcagaccagaaaacattcgctaagtatgccttataggccataccagcaaagagatgtacaaatttgctaaaaggacgttgacgacgaacttgaatctcacacaacgccgccaacaggccgatgactgctagcgcataccccgtcattgatggtttgtaatacggggcgttgcgcaaattaaccgggaagccgtaactgaacagttcccaattagtccagatcaggccaactaaccatagaccaagtaatcccggccaccacttgttaagcatgcgctgaaaggtatctcgaaacacccaagctaacatgccatagaacccgaaaatctggaaactgataaaaagccggtccagtaaataccaatcacggctgtgaggaccatggaaaacttgttggtcataaaaccacaaccaaagaacggcgaccagtgttgtaccgccaaatacgatccagccgcgtcgaggtcgagactgacaccaacggccaagcgcccagaataacggcattaatatgataaattgtagcatcatggtgttataccacagatgaggcgctgcattaccattaacgaactgccataaaaatccccgccagtcatgatactggctaccttgctgcaattgtggcatcaagattaagtagatcgcggtccaccaaatcgttggaataaacagcgcatgccattgctggcgcaaatagtcggtataggtcaacgcggtctgattaagcgtcaaacgcgtcgtcgtatagagaatgccaaaaataaaggccggtgccgtatacttgaccagattataaacaacaccaatcccagtttgcgtggcaatcgacggcccacttgccaatgcgtctgtgagaatcggctgggccatcaccgcagtacaggcccctagtttgaggtaatcgccaacgtcagtgacctccatcgacggactagaaatcatcgtcactgctaccacctcttcgaatttttaccagatcaaccgatggtcaaccttaaacccagtctaatagattcccatgggattacaagtacacttcgcgaacattaccagctaatgattgtattttttgatacgattccaactgctttacccttcaagcaaaccatacacttaagcgaccatttaggcaaaaaatcgcgtcagaccagtcagcattagccgatttacggtcagacacgatcgtgatttctttattatagattcctttacagatttcaatccggtggtctaagtccaacttgcaagtactaggctgagcagtatccaaccaccagattactcagcgttttggtccaacaacacaatggcctttccaaaactgtctgccgcttgcaaataagcatgggccgccggtacctgattaaagttaaaaatccgagcaggggcgaccgacacatgatatgctgcgatgaagtcaaataaatcttgcaacaatgtctgagaaacatcgccagaggaaaagcccgttaaataacacccattcagcacccggtccgtcgctttaagctgcaaagacttaaaaatgccataagccgtgtagtaggtctcaggggttgccaccaatgaggcaatcggtagatccgttttgatcggataaacctgctcgttcggtaataatacgtattcggcataactaccatcatatgcccgacccatctcgcccatgattgaaaccacacgttgcccagacgtgaatgttgctggcgcactggtctcatcgaccacaccaactacttcgattccgagcactcgtgggaactgcacgctcggtgacttgccttcccgcgtaaagatttctgagtggttgataccaaaacctaaaacttttacccgggtccaccccggtttgacgttcggtttaggaagcgtcgttaattgtaacgcttctggtccacctggttggttcacgacgtatacttgcaactttgctacctccgttcgtttttaatgccaatttaacgatagctgagattcacgcttttcgcaattaattaatcccctgcggaatatcaccgttaatatcagcattgtaatcatttagtcaatcgtcgccagaggtcgccggccaccgtcaaaccgataccagtcattaacactaatacgatcactattaaagttagccagccactaatagccggcactccccaatcactgctagctaatccgatggtcaacaaacagttcaagccgatggtcaccccaactgcgcgactaggccgtccccgccaaaatggaccactagtacgagtcatcaagattgttaacattgcactaaatatgagatagacgtaaagactagtgctcaactgaccggcagacaaccccaaaccatgcagccagactattaaaccaacacccacagctgtccaaccagtcgctaggaaccccgcaattttgcttaagcggggcatatcccactgttcgggacgatggcgaatggttgtgcgatcagtgccaaggaccaatgttactaaatcattcagaatagccactaataccatcgcattcagcgacaatggcacgtaatctagccataaatagccgattgttaaaagcacggtcagttcgaccgtccgagtgagtttggtaattgtccaagtcagcatccgctggtagacgcgatgaccactgtctaaaatcgtcagaatatttgccaaaccacccgttaacaggacgaacttagcacttcgtttggctaaatcagtggcattgtcaacggcaatcccaacctccgactgctttaatgctggcgcatcattaacaccatcgcccgtcatccccaccacgtaacccgcgcgctgcatagctttgacaattgccaatttattctctggaacaacttcggcaatcccggcaacttgcgctaacggtcgcgagtgcgttttaaaggtctggtaggaaaccacttggccctttaatccaaccgcatcagccacagcctgtgctgtttttaaattatcgcctgtcagcataatcgttttaacgccccggtgttgaatcctttttaaggccgccgcactatctgggcgcggttgatcttgcaaaatcaacacaccttgtaaaacattattaatcatgaccgccactgaacggccccgggtcaaatccagttggtcgattgctaaagccggttgctgtgcggttaactcgtacaaacgactaagtgcaccaatacgtacccgcacaactgttggcgcttcaccaactagcgcttcggcataaccaacacttgcatcaaatggcttaaattcctgctgtggcagccgtttcaactgatagcgatgagcaaagttcacaattgcttgatccaccacgctaggatgtcgcgaatcggtcgcgctagctgctaaccgcaacaattgctgatctgatctggccgacaaatttttaaactgcacgacttgcggctgatttgtcgttatcgttcccgttttgtcaacaagtaataaattcaaattggcagcttcctgaatacccgttaattcactgaccagaatccgctgccggctaagttcacgggcttctaccgaatttgcaactgcaaaacttgacggcatggcaatcggaatcgtcgcaatgaacagcatcgctagaaacggtaacatctgaatcatatctgcatggcgaattaacgctatcccaacaatgatgagtgctagagcactatctaacaatgccaaataaccaataattttacccaataatcgttgtaaatgaccaggcgcattgttttgattaatcaaactgactgtttttccagcccgactatgacttccagtcgccagtacgcgtgctaaagtttccccggctaccaccattgtgcctgcaaaggccgtttcacccgacgtatggataactgcaacggattcaccggttattgagctttcatccgtatgaattggattcgtcaacacacgaatatcagccgggattacactccctacctgtaaactaatcagatcacccacaactaaagccttcgcatcaatcaactgccaatgaccagcacgacgtaccgaactggttggcgtcaattgatgcgccagctcctgtaaaaccaaggccgcacgtcgcgattgaattgcaccattgacggctgcaaagaccagcattaacgcaataaagccagcctgaatttctttacccaaaacaacttcaataactaaggctccctccaaaatccatgccgatggttcccatagacgactgactacggccttaaaaaagttaaacgttggttctgggacatcattaaatccatctgccgctagtttagcggctgcttgttgctccgttaaatcttcaatcatgtctgcacctcgaatttgacaagcaccactggcaacctaactgtcgaatcaggtttatcacaaataattagtcaaacatcacgttatttgggaagtgtgccaaccgagcaccgtcagcacctaattcttcctcaatccgcaataattgattatatttttcaacgcgttcagagcgggctggcgcaccagcttttagctgagccgcattggtggccactgtgaaatcagcgacgaaagtatcaccagtttcgccagatcggtgtgacatcatcgtggcataaccatttttgcgagctagccgaatcgcggccaaagtttcggtaacggtcccaatttgatttaatttaattaaaatattgttagccatcccccgctgaattgcttgccgaattaattgcggattagtgcaaaccggatcgtcagccacaatctgaagctggtcaccatgagcagctgtaaagcttgcaaagttatcccagtcctcttccccgtatgggtcctcaattgaaacgatttctggaaatttcgctaataactgcagataataatcgccaagagctgccggcgtgtacgttttgccttcaaagtcataattgtgggtcgttcgattataaaaatacgaggccgccgcgtcaaaagcaatcgcaatttctttaccaggtgtataaccagctttaataatcgcatcatgtaacatttgcaaggcttcttctgagtttttaagatcaggcgcaaagccaccttcatcacctaaaccagtcgtgtacccggcatcttcgataacttttttcaaagtatgataagtattcacgatcttttcaaaaccatcccgaaaactggttcgttcgaccggtgtaatcatgaattcttgaatatcaatgccattatctgcatgctccccaccattgatcacgttatgaaatgtttggggcagctctaaatcagtgccacctaagtaacgataaagcggctgctgtaatgcgtttgccgccgctcgtgccgttgccattgaaacacccaaaatagcattcgcacccagacgcgctttgttaggcgtaccatctaggtcaatcatgatttgatcaatatgggcttggttaaacgggtcagcaccatgtaaagcatgattaatgaccgtattaacattattaacagccttaagaacacctttgccggctaaacgatcaccaccatcgcgtaattcaactgcctctttttctccagtcgaagctcccgatggtacttccgcgcgtcctagcgtcccatctgacaaaataacgtcagcctcaactgttggattaccccgtgaatcaaaaacttcgcgagcctttaccgtttcaataacttgtttttccatatcaatctctccttcttaaccaaaaagaaaagacgcctactgtctgaaaaacaaacagtagacgtcatcaaattgattatcaattattatgtggcgaacgtcatcgccgattaacttttgaacaactaaagattacaccttctcaaaacaatgtcaatctttttataacatttttatcgttgaccagcttgacgcgtcttcattgccaatatcatggtccccaattcaatcagcactaaaatcagcaataaccccaacgccatggttgaccctaacgctgtccgatgcgcactagttccagtcgtctgtacttgaactaacgtgataacggcggacacgactgaagtcccaatggcccctgcaaactgctgcatggtattgaacacggcattgccatcagcttgatgctcagctgacaactgctgtaagccactcgtcatcgtattactcatggttaagccaataccaatcattaataaaatgtaaatggctaaaatcaaaccgcctgacaggtgcatccccaacaccgtaaacagtgccatggcaataaccaaaattgttgaacccgttaggactggtttggctgcacccagactgtctagaatacgtccacctagtggggcaaaaacagccccgattgccgcgccaggtagtacaaacaagccagctaacaaagcactcttgccgttcactaactggatgtagttgggcaatatgaaggccaacccgagggcacagatttgaaccaaaaagtacgccattaagtgcaaatcataagattttgtggtaaaaatcgccagattgattagcggttgtgccgctcgacgtgtgcggataacgaaccccacaagaccaatcagaccgactactagccaagccacaaaaatcagtggttgcgtggtaatcgtggctaatttgctaaatccaattgtaaagccaacgaataagaggacgatcatcagccaaccgaccacatcaaatccaactttaactgtcggctgggcttgccgaatcgcatatagccctaacacaagtgaaatcacgagtaccgggatcagcagcacgaaaatccaatgccaatccatccaactaacgatcaagcccccaaaagtcggccccagtgctggggcgattgcggtaatcagcgtgccaattcccatcaaggtccctttctgccgtgccggtgcccaatcaataataatattaaacatcaacggtaaagcaatcccagttcccattccctgaatgattcgtccagtgactaaaacgggaaaactggtcgcggtcgcgtcaacgaccaatcccagtataaacaataaattggctgtcacaaacagcgttttagtgcgaaaacggcgtttcagaaacgccgaaattggcacaataattgcgactactaacaagtaagccgtggtcatccactggaccgtcgccgtattgagtgcaaattctcgcatcaacttagggaaagtgatattcatcgcagtctccacgatcactccgcaaaatgaaagtaatccggcagccacgattgcaagaatcaatttgaggtcaacacgtttttccatacttaaaatcagctccttaacctatagttcgaatacgaactaattaactattttagcacactatttcaaaattttaagccctattttaattgactttttaacaattagttcttataattcactttagttagaatacgaaccataatatcattaaggagtcctcccatgcaagattcattagggatcatgattaagaaagcgaacaatgcattagccagggactcagaccattatgcaaaatcactgggactaactggcatgcaaatcagtacgatcaactttattgccaacaatgaacagcatcacgacctcttccaacgggacttagaattagagttcaatattcgtaaagcaacctgttccagcctcgtttccaaaatggaagccgctgatttactcattcgcgtgccagcaaaggacgatggtcgctacaaacgactactcctaacacccaaggcccgccaattagccaccaagatcgaacgtttctttgaaaccagtgaacaacgaatggcgacaattttaggggtaaataccgccgaaacttacgaagccctgcgacaaattgccgttgctttttcaacaccgacccatgcacctgaaaattggtactaaccattcaaagacccgctgacagtcactgactgctagcgggtctttgattttacgatcaatcaacaccgattactcggccaaaaaacgtgtaaacagctgttgataaattgcaataaagtcataaaacatctgttttggtaaactttcattgacctgatgttgggtcatattacccggtccataaaccgcaaagggaaaatcggctggttgacgcttagccaaattagaagcatcggtaattcccggacttgaggcaacgacaacatcgcggccagcatagggcttgccaatggcctgcactaactttactaaccgattatcagccgtggttgcaattggtgactcattcatgatagcggtcatcttaatgtcagcaccttgctgattatacgctgcgatcaggtccgttaatttttgggtcacttggtcattatcgtattccggaatcgtccgcacattaacgagtgcagtcgctaaatcgggtaacgaatttacttggtccccaccgtttaacacgtcaatgttaaatctgaccggtcccatctcgcctgccggaatcgtttcaaaatagtcattggcttcattgagtaatttaatcagcgggactaaagcattatagccgcgttcgggtgtcgaactgtgtaccgccttacccttagacgtcaattttaagtcataagaccccttctgctcagccgctgttccataaaccgttgaaggttcagcaatcagtaaaccagctgcatcttgcatcgccccttgttgataaaaggcagctgagccagcttcaccaacttcttcgcccattgtcgccaacaagcgaatggtgccatgtttagggccaccttgctgctgaatattgatcatcgcagcgactaatgcgactaaaccagccttcatatccgtgacgccccgaccaaataactgaccggatttttctactaaggtgaaaggatcggtgtcccacgccgccaggtcacctgccgcaaccacatccatatgaccggaaaccgctaaaacaggctgcccatgaccaatctctgcaactagatttgcacgatcaccggtaatggggtaaatcttagctgaaatatcatacttcgccaacagggcttgcaaatattttgcgaccgtcaactcatggtcgttaactgatggaatcttaatcacatccgctagaatcttaagcgctgcatcgtcttcaatcgttcgcatattttgccaccaactttcttatgataatttcagtctaacacttctgaaccttctattttacccaataacctctgctacgttatcaaattttgttgaaattaatatcttagttatcaatcatcatgttcgtgtcaaaattgaggttcgccccgttgtctgatcattaaaatattcatactgaactagttcggcatacgacccagcaatgttgaccacattcgtatagccgcgctgaagtaacgcgcggaccatattgtaacttcgctgtccagtctggcaatgaatataaactggctgattggtcggaatttccactaagcgctgccgaaactgactcagtggaatattatgagcgcccttgatgtgcccatcagcgtactcttgtggttcacgggcatcgatgataaacgcccccgccaagaccagctgtcgaacctgcgtcaccgcaacctgcttaaattcatcattcaggacgttttccgccaccaagccaaccatgttgacgacatttttggcggtactgacccatggcgaataacataattcaacatctgtcaggtcactgactcgaccgtgcatcgtgattagactagcgataatatcaatcggtttgtcaacgtccgattgaccaatggcctgcgcgcccaaaatctcaccggtcggataactgaatatcaacttaagaaagacggctgttgtccctggcatcacgctgacccgattctgtggtgccaccgttgcgaaccgataatcaagttgctggtgctcacactcagtagcgttcaggcccgttgacgccacgtttaacgtaaagacgtgaagaacctgcgatccgatcacaccctgatactgtggcgtccgcccgtataaatgatccaccatgtgtcgggcctgcatttgtgcaggaaatgccaatgctagccgcgtagattgacgtgtaagccgattagtcatttcaatggcatcacccaccgcataaatgtcggccacggacgtctggtaacgatgatcaaccttgataccaccggtcacgcctaacgcacaacccgcttgaaccgctaattcagttactggtgtaaccccgattgccacaatcactaactggctggtcacggcgcgtcccgaggcgagctgcacttgtgttgcaccaatggccgtcacttgttcttgcagtatcacctgcacaccgtgatcgtatagttccttgtgtactagctgagcaaactcgtcatccaaagtgcccaagacgtgctcggcagcctcaatgattgtgatctgatagccagcctgttgtaaattttcagccatctctagtccgataaagccaccgccaacaatcgtcacatcatgaacgtgttgttcagtcagatacgcttgaatcgttcggacatcttgaacattgcggaccgttttaacattgggccggtcgattcccgcaatcactgcgggtagtatcggtcgagcaccaggtgaaagaatcagtgtatcatatgggacgatcgtcgttgctacctgtccttgccgtttgatcatcactgtcttagcctgcgcatcaatggcgacaaccgttgtattcacttgaacgtcaatattgtactgttgctcgaattgcatcggtgtctttaaaatcacgtcatcgggctggtcaatcacatcactgaatgtgtacggtaaggcacaattggaaaatgagacatccggccccttttcaaaaattgtaatctgggcgaactcgtccaatcgacgcacgcaggccgccgctgaagcaccaccaccaacgccaccaacgccaccaacaatgaccacttttttcactttcatctgaaccatcctttcgtaggtatgctgtagccctgccactaattagcttaattttaagggtttcaaggcgtaaccacaacatcaacgccgattaattcaaccgttttcattaattgacgtcattggctttctatttaagctaaaataagttagtatgtgtttaacacttaaaaaaacttaaggtgatcaattatgaaccaaaaaacacgcttagcattgattcttgatgaattaaaaacccacccatcactgagtttaaaagacattatgcaattaacggggacttcacgcgacactgcccggcgcgatattgtcaaactcgcagctcataatttggctgaacgaaactacggcggcattagtcggccgaatacgtttaataagctagatcagtacccggaccgggatgatgacttactgcaaactaaacgagccctggcccacactgccagttcgtatttactaaatgatgcgttattatttctagatatctcaaccaccgttgcctgtctaccacaatatctccagtccaagcaccccggcatgatcgttacgaattcccttgacattgctgaccaggcattacgacatagcaattttcaaacgcgtatcctgggtggcacattagatgcacaacaacggtgtgttcaaggcgctgacagcattctagcactacacaaatttcaatttacgaccacggtcttgagttgcgctgggttgaccgcagatggcgtttattacgcttacgaatctgatatcgctttaaaggaaacgttacgcgcccaaagcgaccggctagtgctgttgtttgaccacaccaaggtgaacgtcagccacaacttcaacttgctagctctcagtgattttgattactttgtgactgatcagccactaccggataacctagctactaaaattgcacctgataaacttatttacctttagaggaggatcattaacatgccatcttcactattaactactcaacgagcaatgttagccctgattcaaagcggattagcctacacgactgacccgttcgacaaagatcgctatcaaaagttacaaaccttattgattcaacaaatggccgccgctgccaacgtcgccactgctgacctgacggctgctctaactcaggactctggctacattacccccaaaatcgacgttcgcggcttgatacgccatggtaatcagctactactcgttcaagatattaaaacgaaactatgggccttaccaggcgggtttgctgacgtgggctacacgccaactgaaaatgtgcaacgcgaggtgtgggaagagactggccgtcacgtcgcggttcaggggctcatcaccgtttttgatactgctctacgtgtcgatattcggtagattgcaaatttaatccgaatttttggacaaatttgtcagcatgacctgataaggtgtttgccagtcaagtattttaagtggtctctgattaatttcgagtaaggtggttttcaagccttgagcactaatgtgctcaaaataagtccccttaggataaaaatagcgtaagttccgattaaatcgttcattactgccgcgctcagctggcgtataagcatggcagtaataggtcttaataccgtattgtgcttcaagtgatactagaccgctaaactcagtgccacggtccaccgtaaaactatgcaccgggccattaaaagttgctagaaacttatttagggcttcattaacagttcctgctgtccggttttttaatcggtaggcccaaaggaaacgtgatttgcgatcgattaaggttaataaaactgccttactatgcccacgggggccaacaattgtatctaattcaaaatcaccgatgcgattacgtcgattaaccacgatgggtcgctgttcaattgaccgtcctaatgattgattatatttagaacgttggtcaaggttacgccgttggcgcacgccatgttcaggcaaatcatttaaagaaaactcaattttcccttgatttaaccaattataaattgatttagtcgctagtttaaattcgtgagctatcatttctggtgaccaacttagccgtaaatggtttaaaattatttgccttaatttgtcattcaatttagtctttcggccacatcgtgaccgcttgtattcggcatctgtttgggccacttcggcctggtaaggttcacatcgagctaattcataagaaattgtggcaggtgatcgttttaggcgatcgctcatttggatattggacaggcctagttcacaaaaggtttcgattttaattcgttcagaataggttatactagacaaaagatcagctcctaaaagatgtgtttgtggtaaacaccattttaaaggaagctgatcttttttgtccgaacagcgttcggattaattttacaatctaccattccccaaccatttcagtattataaattggtctttgcttgtgaaattactgatggccaatttgagcctaacattgaggtcgcccaaacagcctactttacgctcgacaacttgccaccgttgtcccaaaaccggacaaccgaagaacagttggcacagctaatggcatcttccactaccatcacagtcgactaaatgactgctgaagcgccaaaaacatcccggctagcctgtctgctagccgggatgtttttgtttctttatgacgtctttcaatcaagttaggccgctattggcatcaacaattatgaaaaagagcgtcggattaacattaatttacatcaacctagtaattaccattttcacaatatggtggactttaagtcccctatcattacatatccaccaatccaactaaggtttgttgaaaattcagtcgccgaatatgccggggaatgaattggcgaatatcatcatcattaaagcctacttgcaatttattacgaccaacaataattggccgccgcaacaactggggttgttcgcataacaaccggagcgtctcattgaatgacatatctggcagcttatcagcaattgcgggataactttgtgaacgggtagaaataatatcttccaatccattctcagttaggcacagaatttgttttaactcactaacagtaggggccgcgctactaaagttcttctcctcaaatgcaatatcatgatcccggaaccattggcgggcctttcgcgatgagttacatcctgcttgcgtaaacaatttaatcataattatttcgccttcttgattagtgtttttattatgataattataacttgtttattattgtagcaggttattcataactttgtaaagacctgaacgaagtaatcgtaaaaaattcattgttttttcatatttattattgtttaaataatataaatgttatacgaatcaccgttgattttcatgctgatcaaacgcgcgcagcaagcgtgacgccagcaaataagccacttcgtacttcaccgtcaactgccacaagaacggcccaagctgatcgtgtgccggggttaaattcgttagtaaattcaagtaacgttgcttctcggccagcgtacactgctttttaaaatagccccagacgtgctgataagccgttgtcaacgtggctttagttggcgtaatttgttcggcttctgctaataattgttggtagcgttcctgttttgcagctgaccaatcattgtgccgagctaattgtcggatggcattataatgctgctgtgagtgtgccatgacccagtacttttggtaagcccaatcttgttgccattgtgacattgctcccatctcctcaatcttttgatgaatttacaaatattgtaccgtctggctcagaaaaatagaaccaatttacattagtacactggtaacagtcgtaagttttgaaacttagcacaaaaatggcgatagcccagttacccgttggtgcaacttagctatcgccatcaaaacttatattttatgagtactactgttgtcaattaaagttgatcagccagaactgatgttacttttcgcctggccgagctgagatcatgagctcacgttgcggataatcttgtggatgttccaacatatcggtgatcaatgtcgccaatgagaatagactaagtggcccaccgctaacagcatttccagctggtttaacaattaattgatccgcttcatcattgtacttgaaaaaatgacaggctagcaatgtatagtccaaatcactattcctgatgactgcggccccggccttttgccccgccacataggtcgtctcaacttcacgactaaacccaaactcgcggtgggctaaggtgtacattgcttctgaaatctgatcatagttgatttgaaactgggtcgtccaaaatagccgtttgaccccaactgcatccatcgcttgcaccaatgccgtggcaaactgcgccgcgtgggtaatgcccaccgttgagaatacgacgtcaatccctcgcagcgcgcgttttaaatcatcaacattgctcgcatccccgattaactgcgtggctaacgagacatcatgctcatgtcggtgatgatccaacaaagtcacgtggtgctgcggcatcacggccactcgacgatacacttcataccccaatttacccgttccaataatcaaaatattcattactgatcacgtcctcacatcactcgctaatttattcgtagcaacggccgaaccacaaatgacgccaacagcgcatatccacaccctatggttaatcagttcggtcgcttaaggcttattataccggttccaagatgataattcggtcattatttaaacttaattgtgattcgatgactgattagccttattttgaataacagggtcaatgacagccaccggtcagccctgagtacggatagctattaataactttgaaataaactaatgtcctaccattttatcttggccaggatgaccaaggcccaaagacaatttattatgcccgcagttggctatgaaaaaagcaccgctaagtttggggtaggaaccgatcctaaacttagcgatgcgacttaactctgttcgcgattgctgcgccaactaacgatcaattaccagtttagccgcgaaagctcatccatcattgctgaacgccgcggatattgttgctgccaatcatgtataatcgcctgcacggtcgatttaccagccgggtaagcaagcatccgtttcaatatgccaactaattgttgatactttcgccgagttccagtagtagtagccattttccgcacttcatgatcatatttcgctaatagcagatctgaaaaacgtggtttcaataacggctcatagatccgtaaatcccagagtccgtctgcggccacgaccgcttttaatagcgggttcaataagttttcttgcacgtacagtggtttcaaatcgacattggaattcttcgcgatcgctgtcaacagttgctcgcgaaccgccggccaatccgtggtcgggtaactctgcttcaactctgaaaatagcatctcatccgctggcgcatattcagtcagcaattgccataattcctgacgatacaattgctgttcacctaattgctgataagcgtcctttagttggcgactaagttccgctaacatgctgggatcgtccgtgaccaactttttaccatcctttagcaattggaccgcgtgcgcctcatcttgatgttgaagacagaactggctataaaacaagcgaacttgcggtatcgccaagttagcgccacaaaatttaataatttgcttatcaggcacatgagccgcagacatcatttgtaaatagtgctttagccatttttttatctgccagtcatagtcccagagatccgggtgtttttgcaccgcacggaaccgcttagcggtatacaccagctttgcatcaataaacgctggcgtcttgaaatatgtgaataataaatcgtcaagcgtatcttcaataatattcaacgacttcgttaattgtttgcataaccaatcaaacacctgctgctgcacatccgcgtcggcttttgttaagacagcttcccacaagtcgtcactagcactcatgatcatcatgatctcaccatcggaatcatcaatgtcgacgtggtcgattttaagcatcagatgcgctaagatttgaaataccaaaccatactcgccgtgatcgaccaacggttgcacctcttcttttaggagagttaaggcctcatcaccgaagtccgtcgccgcgtcataatcgataaaaccaccgccatccgcgtttgtgtcaaataaatcatcaacactcgcgagatattcaggtaaatctgtcacaacattagtctcacccatgaccgtccggaacagctggacgagatgcttgtcatgggccaacaccacactcaaaaagtcccggacttgccgatcagtagcccgctcaaccagcttagtggcagtctgttcaagactgtcgaaactagttggtgctttggaaacttgctgttgactggcaggtttatcagccgccatcgcttggtacaaaacggccgccatgtgcttgcagtacggatgactattggcatacggacactcacacgcgccaccgtgaaagtcaccattagcgagatcaatcaccacgccatagtcctgcgtgcccgtaaccattgccgtaatttgtgttttggtccgttttaaatcagtgacatacccctgtaagtaataatcgtacccacgttcagcgattgccgttggaaaatagtcttcccagtccatattgtcactcccgttaactcgtttgtcctaaccatactgcggtatggcggattgggcaagatccggcaagcaatttctcaccatatcactcaataccgaccctcatttagcatacgccgtgtcataactttatctgttgacactaaaaagcttgttttttcaccgtggtttgtggctcattggccgcaccaatccatgaccaagtcgccgttgcaagtagacccacaactgctcgagcgaagtaaacacgatctgatcgctggcttcaacaattggctgattaggatcccacgccgccgtcaaacattgcgccccggccgtatcagctgcttcaaaatctgagcgagtatcgccaacgtacaagagttccgcggcgtctaacaacttagtgcgcatcaattgtcgcagattgtcagctttattaggttgatactcagaaccatacaaccgcgtggggaaataggacgtcaagccagtcacgtccaaggaaatttgacaactcttagccgccttacccgtaatcagagctagcgccaccccttgctgctgcaacagttctaaaagtgtgacgattcccggatacggtgctgacactcgtaaatgtgcgcgagcgtattcttgataaaaggcggccaaagcgaccggccaccgttgaccagccactgctttgaccatcccaacctcatttagcccaaacgtctggacgatagcttgcttggtcagttcgtgctcaacgtacggtgcaacgctacgacgaaagacgtcaatcaccattggaatcgtcggcgcgagcgtgccgtcaaagtcaaaggcgatcatcttaagcatgcggttcaccttgattaatctgccgaatcacacgacaaggattgcctaccgccaacgaattagctggaatgtctttgacgaccacactaccggcaccaatcacggatccccgaccaattgtcacgccgggaataataatcacgccaccgccaatccaacagccatcctcgattgtgactggccgcgctaacgtctggcaaaaatactgatcactatctggctgccagtccgcacgtaaacgttcatgcagttcgaccggatgggtagccgtataaatttgaatatttgaggcaatcaagacattattgccaatggtaatccgattacagtcgatcaaggtacagttcatattgattgaaacattctgaccaatcgaaatattacacccgtagtcacaaataaatgggctccccaccgaaacattcgatccaatcttggcaaacatagcctgcaatatcgtacgtttctcacttttttggtcataggcgagctggttatactggcttaaaagttgccgtgtacgccgttttagctctaaaaatactggtgcgtgtacatcatagatctgaccgctcaaactccgctgtcgttcatccatcattaagcacccctctcacttccaagcttaaaaaacgaatcgttactattcaagtcacgattcgtttctttagttatagtcgtttcgctaaggtctcaatcacatagaccacggggacctgggtcgttatattataattaccattaattctctggtgagccaattgatatgaaaaattccaatcggaaagcttcgctagcgtggattgggactggttagtaatgcttaagactgcgcaccggcgttgttgaaaatgctgaacaagtgcaattagttctggggtttcgccactctcagataacgcaaaaacgaccgtatcgtgaatctcaaaggcattcactggataattactatcctcaagtccaaacgcaaccttaccagcgttggtaaaacagcgcgcggcatagcgggccaaactgcctgaggaaccaatgccgacaaaaataaccagcgtagctcggcgcaaatacgtgagtgctggcatcaacttacgttcatacgcgctagaattagtttttgcaaaaaagtgtgctagctcactgacgtcgctcttgggctcgtaggtggtcaactgttgttcacttttaagtgcccgtttaaaatcacgatagccttcgaacccatttttaagacaaaaacgcaaaatcgtcgaggtcgacacgtgcaactcgtgagctaactcacgaatgctcatgtagccgaccctatccatattattaataacgtacctgtaaatttccacatcagtttcattatatttttcgagctgctcataactaaacatccgccactaccccccactccaataatccgttgcttggtcaccataatgacctggtttgttcgaccctcattagtcatacaatcgattggacgcgcaactactatcaatagcctactataatcagccactctgatcgcgctagcaaacgaccaacaccgttaccagtaatcagtctttatctatttaagcgcgaataccccgttattacaagttggtagcaacctaaaaactaggctaatcactgacaaacgtcagctgactaccccagtttctttagcgtcaattttaaaaatgcgaactcgccagtgcctgtccatcaggctgccccactttaatgtgtgggccataaaaaatcaatcagtaaccggtcgacctgcgcattttcatgcaactggctgtgttgcgcatgtttcccagtaatcttaacctcgcgataagaacgcgcacgcgccgcaactaagtaccgtaaagagcgtgatgaagcgttactgacggacccatccgaatgcgtcccatcgcccttatcgccataaatattaaggactcgtacttgttgacgtggataaacccgccgcaatcctaataactggcggtaggccggtcgcaatttattcggtcggcccgcagcattcaacgtcatctggttagggctgtcgtccatgcctaaaataccattgaaatgtccagcaattgcgacttgtcgcctaagctgcggcaaccgcttattttgcgcattcgccaatagataataggtaatcgccatattacccatggagtgaccaaccatgttaaacgacgtgatgccataggttcgttggagcgccaccaccacattttttgcccagcggcccacggttggataatccgaagaccggttattagcaaagtttacttcgataattggtcgataatcgcctgatttaaagcggcctttcaaagtcaccgtcccatttttggcaaccatcgcgcgtacaatagtttgtgttttgccggctttaacgatggcatctgccatgtgcgtctcagcatggtaactactgccccacccatggaaaaacagtgttggaatgtaacgatgcccctgagtcgcaaccggtttagtcaccccggtcgtctctgcacgaccacaaccaactaataataacagcaggcctgccatcagcccccataagcgtattcttttcaataacttccccctgaattctatttaatcatctattcactgttagttcgtcatttgaatttgcgccaccccgcatcggaaggcgttgtcgtctgagcgttaacgcctattttagcattcaatcaaggctcatgacaggaattacaaccaactaggccggtcacccgccgtaccaggtttatcgacccctaaactgacacgctgataattttcaggatgcgccattaatttaaagactaaatcggcaacacttgctcgtgatacctcagttcctttaaaaggttctgcgccagtcgtcaattcataatcaatttcggcaacatccgttagccaggctggtcggatctccgtataaaccagtttggaagcactaagcaacctcgctgcttctcgaaaaccgggtaggaaatcggcaatggcttgttcgttccacgcgccaaattttcctggcacctcatgatgggcgccgagtgcgctaatgaagatcaaccgttgccgctgagttcgggccattgcggctaaaatgctcttcgtctgggctgctagatcagtcccaccaacattggaatagactatgtccaccggtgccattgctgtggcaagttcatccgtatcaagcacgttgccatcaatcagcgtgacccgtggttgctcccgatactgggctaaacgttccgctcgacgtaggaacaataccagttcatcgtcagtttctgctaataaccgttgcgccagcttcctggcaatcccaccattagcaccaataatcattattttagtcatttctattcacctttcttagatattcgtggcatcacttggaccgtcgcctgccgcggtccacttgctagcatcggcattaaatacggactaccggcatatttttgtcgataagcttggtcaatctggttatttaactgctcatcacaaatgggcacaaaattcaccagatgattgctctcggccaagtgaatccggccagccctttgggttacggccgatcgataccagcgtgagcgcggaccgttccaagcacggataaatagttgctgccctaccacgaccgaccaaatccaggtcggtgtcccgtatgtctgcccatcactgtaaaatggggagacttgaaaatcatccgccgtgctaaaagcggctaactgtgctctggaccactgcatcgtggttacagtggttgacactacgggctgattacttttgttcatcgttaacattcctccattctggcaaaatagtggtgcttaattcagagcacttcggttaaatggtgccctgccttgatgcttgacacgttattctctgaataaccaactattctgcactaacctcaagtttcatcttaaagcttgacagcaaccatgtcgaatgcttatatggtatttaaaattatacttaattgtaatagaaagaagtgctttagatggaattacgagttctacgttattttcaagcagtggtcgccgagttaaatatcagtcgggccgctgaacgcttacacgtctcgcagccaacaatttcacgacaattaaaggatttagaggatgaactgggcgtgaccctatttgaacgcaatggccgtcatatcagtctcacgagtagtggcgaatactttgccacgcaggcgaaccaaatcatcgccttagccgataagacgcttgccaacattaatacagccaaagaaatcagtggcacgattgaattagggagtgccgagatgcgcagttttttgacgattgctcagtcgattaagaaactacaacaacagtatccgaaaatcaggatcaacgtgacgagtagtaatgcgaatcagattcgaaccaacctcaaaaccgggaactttgactttggaatcgtcacggaaccaactgacaaacacgacttaaactttatccatctacccggcgaaagtcgctggggattactggttccgcggcattcgccgctagctgaccatgattacattagcttagctgatcttgaaggccaaaagatcattgtttctgcacaacacggtacgatcaatcaacttcaggattggtatggtgaaagcacgcccaaattcaccatcgtcgccacttataatttactctataatgcctcgttactagtttctgcgggcgtcgggtacgcgttggggattgatggcatcatcaatacgaaccaatccgatttgattttcatcccactaacacctcgaataaccgcccgcactagcctagtctggactaagggacaacgcttgtcggaagccgccaaaacctttttaacgcaactggcgacagacctgcagcaacaaatacctactgactgacactatcgactcagctttcaccaatcaccacaacacactgcccaattgatggctgctgaagacgacgcgcatctaattcacgctaattcgaactaaataattgaattgagcacaactaaaatgctaagctaggttattcagtttcagggaggaattatttaaaatgaaagcagtcattattaatcagtacggtgggcccgaagaactccagatggccactatcgaacgtcccagcattgatcaggacgaggtcttagtcgccgttcaggcaacgagtatcaaccccatcgattggaaagctcgtcaagggttgcttaaaagcatgtttgactggcaaatgccagttgtccttggttgggacgtcgctgggaccattgttgaggttggcgcggccgtgaccaactttaaggttggtgatgaagtctttgcccgcccagacatttatgcggatggccggcgcgggacctacgctgaatatgccgcagtcaaagaagacaagttagcactaaaaccagccagtctttcttttgaacaagccgccgctttgccgttagcggggctaactgcttaccaagtcattcatgaccaattaaagattcaagctggcgagaaagtcttaattcaagccggtgctggcggggttggtttaaatgccatccagattgctaagtacctcggtgccgaggttgcgactactgcgagcgccaatcaccatacgctgttgaagcaaatcggcgctgaccacgtcattgattaccacacgacggctattcaagatgtccttacagactacgatgccgtctttgataccattgacgccattgatgagggcttggcaatcttaaagccaactggccgactcgtgacgattgatgggcaaccaacggcggctcaaaaatcccaaggccccactgtctccagctggtggttgcaacccaatggccgggagttagccatcttggggcagctcgccgttgaaggacatttacaagtcatcatcgaccaagtctttccgtttagcacggctggtctccaagccgcccaccggtatagcgaaaacagtcacagtgctggtaagctcatcatcaacgtcggcactgaagcttaatacggtatcggctccagcctcagccaattgaccaatcgccacattgactgtcaaacgacgcattaaagccttaaaagggcgcttcaagaatccactacgaattcttgaagcgcccttttttaagccccattgcccgaataacgctagttgtcacccctgcattttcagccgcttgtcccatctgtgcctcggcgtgatacctattaccgccaccgtggaaaaataacgtaggcgtatttgactgtacatacttcatgcggtgttgttgtgccatacatccactgagccccagtactagcaaaaccactagcaaccccgacagccatttcacttttacttgcatgtcctgattcctacttttgactggaatctattatacagggttcctgtcagcgcaaatcaggctttttcaccaattatgggatgacgaacagtgctttcatcatttggatggcataaaaacagacttgggaaatgaccccaagtctgtgatttaatgcgcctgtgctgctttacgttaggtcaatgcttatcactactattcgaccagttaccacgagctgtaattcgtggtgtttgattgcctcgctgatattcttgttggacggctagttgccccaccaaatttaaatagttaaacggttgattaaaattcggctgaaagaacatatccacgtaagccaaatcatcaatcgtattctgattttgaatcattactgagatcgtgtttgcagcttgggcaatgtcgtgacgactccagaattgcgcgccgagaagctgacgattctgataattataaactagttcaatcgtgactttggccgtcgttggcatataagatggccgccaattgccttgatagacggcgtgtcgtactggtagttctcgtctttgcgcggctggataggtcaacccagttgtggccatcgtgtgatcaaataattgcatggctgaggtggcttgcgttcccatgtacggctgtaaatctccgaaaacattgatccccgccaacgcaccttggcgcagtgcgttagttgccaatggtgtatacgccggctgtcccgtgggattataattgaccaagcaagcatccccagccgcataaatatccgggtcagaggtttgaacataatcattgatcaagatagcaccatggcggtccatagcgacctgcccgcgtaacaattccgtattcggcataaatcccgcgcaaacgacggccagatcaacctcataatcaccctgcgcggtttcaacgatcaactgatcattcgaaccgcttgcgaatccagtcacccgttcattgaggtggatatcgacctggtgatgttgtaagagtttagttgcagcatccgccatttggggaccaagataattattcaaaatatgtgaatgcgaatgaaataacatgacttgttggtccatactagcatagctttccgctaactcggtccccatatatccggccccaacaattgcaacgcgttggttggcttgtagagattgataaagttgttccgcctgctcgtagtttttgcacagtaatactttctcatgatcgatacccataattggtggcacaataactgatgaaccagttgccataatcagcttatcataagtgtcatcaaagacttcgccagtctgcatattggcgacctgcaccgttttatggcccgtatcaattcgtaaaacattatggcgggtcttaacttgagcgcctaactgcttcaagtcagccggcgaggtgtaaaacatgtcttccaggtgttggatgacacccgttaagtacaaataaatcccactcgaaacaaacgaaacgttatcattccgctcgtaaatcgtcaccgccgtctccggatgacgtgttaaaatttcgcgtgccgctgccgtaccagcgtgggtactaccgatgatcattactttcatcttaccggatcttccattcttccagatttgccacgtaattagtaagtgggctcaacattaaccactattcaattaattatatcgcgcaccaaatcatttgtatatgtgttgataaaaataaacctagttggcccctcgttcaaacagcctagctttacaaccactgattagctttcgccacacgaatcgcttctaatcgattgtgaacccccaatttgctaaaaatggcggataagtaattacgggtcgtccccgctgacaagtataaattggccgcaatcgtcttcgtgggcaaccccttctcagcttcgaccaaaactgctagttcccgttcggtcaatggattgttgtctgctgacaacatattcgtgactagctcgggcgcatagatggtgcggccggtcatcacagctcgaattgcatcaattaggtcatcactcggactatcttttaacaaatatcccgcgacattggctttaactgctcgttcaaaataacggcgttgcgcaaaagtcgtcaaaactattactttcgtggctagctgcgaactggccaatcgatcagcaacatccaagccggttatccctggcatttcgatatccagaattgcgacatccggttgcagttcttgcaactcctgccaggcgtttatgccgtctactgcgctacccaccacgtgtagatcatcttctaattccagtaattgggtcaaggcagaattcaacatgctttggtcttctgctaagtataaagttatcatgctgactcactactcctttggtaaagttaagatcaactgggtgccgcgccgactactcttgatggcaaaggtgccctgtttagcttgcaagcgggttcgcatcccggcaatcccgttggcgccctgacgaatcaaggttccacctttaccgtcatctttcagcttaatctgataaatttttgccgtctcgacaaaatcaatccgcacctcgtgcgcgtgtgcgtggcgcatcacattggtcatggcttcaactaacaccgccgcaaaacaactttggaccgttgtcggccacttggttgcctgtgtctcaccagtggtcgtcgtccagacaccagccgctgctagattacgagtttgggccaataggacttctgtgagcgattgttcatgcaaattattgacgatttcgcgaactaactgtaaattttggcgactggtttgttcgatttcgtccaattctggtgccactttctccggtgctttgacgagtaattttttagctaattccgttttgagtgtaatcattgaaaagctttgtccaagggtatcgtgcaagtcacgcgcgattcgttcacgctcgttacgttccacaattgtttttaatcggcggttagtttggttgagttggcgctgtcgttcaactgaccgcgaaaaggtatacgcgagtatgggtgataacaatggaaaaactaaacccatcacgtcaccattatgccacccaaacacaccaggatattgtaaatagtctcgtatacagccaccaagtaaaaaggcataataccctaaagcaaaaccataaaattctcgcttaggacgacgaccaagtaaaaagctcacttgccagccgggaaagatgatcataaaattgttagccgcaaataccgcaaacagtcccgtcacaactaactccgctggcatcgtcattgcacgccaatgcggcttctcaacaaccaagatgtacaacacaaggaagccaccaacaagcattagccaaaaccaatcataccaagatttaacgggtatgtaagccgcaattgtatacggcaaataggcgagccacacgtagctcgtccattcaatcgtcttcaagttgtttctatgatgcgtcaacaacgccattcccccgtttaagtacccgctgaatcacccaactaacaatcactaataggccgcacacccacagcccgataccaagcaaatcgattaattttagtgtaccatgggtgccccagttgaccaacaaatcgttcacataatatgttggcagtcgtttaccaatcacctgtagccagcttggtaataggctaatgggccaccatagaccactaataatggccattggaaaggtaattaaattactagcgacactcaacgtttcggcacgattcaaaaatgagagtccaacgcccataagcaatgtcggtaattgaccaatcagagcaattccaagtatccctagccattgaaccacggttaaatcaacgtggttcacaacgaccgcaatcgcgcctaaaataacgaccgttaacgcattcattcccaaactcatcatgccaatcgaacgatagtacggtactaccccgtgtggcgttaaccgtagccaccgtaatagtccccgttcccgatcatgcattagaatctgggcaatactgaacagcgtactgatcgtcccactataaacgatcatactgcccatataagaccgattaaaaagtgcgatttgagccgttgtgccaccggtaaccattacttttgtaaataacaagtaaaaagctgctggcatcaccaaggcaaaaaactgaaacgctgcgtttcgaataattaaacgccgtgcatcaaatctcagttgagccattaaaattttcatgctgagactcccttcgtcagatgaacaaaaatatccgtcaatgattcacgactaattgagacttgatgcaactcactgattatgggcatcatcgcttgcagcgtagcgtcaccgtcttcactactcatgcgtagttcgtcgccttgcttagtaaccgcagttactgccgttaaatttgtaaaccgatccgctggcagtctcgtttggcaacgaatccccacttgttgatattgtttttgcaacacggcaaacgagccttgaaagacaaagcgcccgtccttcagcaacataattcgatcagcgatggcttcaatctccggtaggtaatgactggtaataataatggttttaccagcggccttcaagcgcctaatctgttgccaaaatgtctgttgcgcattggtatccatgccaacggtcggctcgtctaaaaataacaaatcgggatcacctaccagtgccaaagcaaaggtgactcgtcgtaactgtcctccagataacgccgtcaagcgttgctgggctatgtcttgtagtttcaatgtggctaataatgcttgccaatcaaactcaggcagacgttgtgccgcagctagccttaacatatcacgcaccgtcacgccttgaattgccatatcgccctgcaacattgacccaatctttaatcgcgccgccaggctaccggccgcttgcccgaacaccttgagatggccctgctgaactcgtttgattcctaataacaaatttaacaacgtcgttttgccggccccattttcaccaatcaagccaacaatctcgcccggcatgatcgtcatattaatatcagtcaaaactgactgttgaccataactaaatgcgatcttagttgcttcaatcaacggtgtcattatccccgcctcctttaatgactatagtgtacgccagcgtaatcgggtcgagtagtcgcgtttgtcataatgatcaggtgacaaatgtcattatttcaacagtattgataagttagcataattctttagaaaataacccagacaaaaagtgagcttctgggtttacatcaaaagctcatttgaatcacaattaataacgctagttaccgtgctttcaatacccaatgtgccaattgcgaaacgataacgattccaataacaccaatgatacgcaaactcaatggcagtgttcgaccataaatgagccaggcagctaacaccagtaattcaccgccaaaaattacaaatttcattccaacacacccaatccacttttcgctagtatacgagccagctaatacaatgtcgattgatctgccattcctaactgagggcggtcgctgattaactgtgatttcacttcgtttagttgttacttgcctacgtatgtacgtctttaatccgccattctccagttggaaaatgattagtccatcaaaagttcaatacattcaaaggtcattccaaccgttaaattagttttggcactgacactagctcttatgttaaacttaaccaatcacaacgaaaataaggaggtcgaccattgttaattaagtctttcccgcctgccgagcgaacaccgcaattgattagccaattaactcagctttggcgacagtccgtcgacgccagtcaccactttctaacgcccgctgaaatcacaaccattgagcacgaagtccctacagcattacgaaccgttccacaactgctcgttgcagtggatgatcaaaataccccaactggtttcatcggtattgatggttcactagtagccatgctttttatcgccccagccgctagtggcgctggtattggaaccgccttactgcaaactagtattcaggattatggtgccacaacgcttacagtgaatgaacaaaacccacgggcgcgtcaattttatgaacaccgtggtttccaagtcactaatcgccaaccaactgatgatcagggccgtccatatccactattaactatgacttacaactgtgacccattaaacgactgacttgacaaggtcgttttttttataaataatggacttgtccactatttataaaaaaaggagtgctgactatcgagtattttagtctaactaaatatattgcgggtatttaccgcgaatccaaaaacagcatcaacacccaactacaggcgctgaacattcgggcgaccgaaagtgacttattactggttgtttacgatcacccggcccaaactcaaaaggacttggctgccagtctgatgctcgatcctagtttattagctcgaactgttcgtcaacttgagcaacgccaactcgtcatccggtttcgtgatcctgccgatcatcgtagtctacgaattaacttgacaccggctggtgaacaaattgctatcgccattaagaaaacattgattgactggtggcatgacttcttcgctgctcatccagaagtcaacgagcaagtgtttacgaaccaattacaacaagtttacctcgccttacaagagaaaagagattgaaatcgtcattgaaaaaattcattaaacactttggagtcctcgtaattggtatcctgtgcatgtcagctggcgtcgcactctctaaattatccttattaggaacgtccccaatttcaagtattccgaatgtcattagcaatattacggcaattccaattggccagttgacaattgcttttattttcattttagttctactagaagccatcgttttgcgccggcagttctcctggcaaaacttattacaattaattccgggtagcctgttcggttggttcatcgatgcttttgtgcggtttttccatagtcttcctaatcaaacatacatcgagcaactcggacttgtcttaatgggaacggtgctcttatcgttaggtgtctttttagaagtcaattcacacgccattatcatgcctggtgaaggacttccgaacgccatcgcactgatgcatcaactcaagtttgccaaagtcaaagtttataatgatttcattctgattggcatttcactagtcctggcactcagctttactcattctttagcgggggttcgggaaggtaccctcattgcagcctttttaactgggcgactcgtaaatttctttaccgaacatgcaaatcgatttgttgattggatgacaccagccgctgacgcgaacaactaatttccagaattatcaaataaaaacacggtcactggctagtgatcgtgttttttggcttgtgttcacgccaattcgttagtctgccagtgcccgaattttttcagccaccaatgcaggtgaacatcggctatccgttaattgttctcctaattgatttactttggacccacatgctcgttattacatgttgtagtaattgtcgatcattttcatcgctaccaaacgccacttagcgctggatccccagtcgttgcaggtggaccatttattgaccctaatagcaatcaaatcaagattaccttctgtggtatgctgaacagtcatcaacgtctcagttgccagcagttaagtacttaagcgcatactctgcatcttcatcaaccctcaataagataactttaatcacttcatccaatttcggcagtccaactctttgtggcaagtgtcgagaatcaagctagttgaaaatcgacttgagccgcacaatctcagcaaccatccgcaatataactcaatcgctagcaaccatctcagtcacgagctgtaaatcatgcgaccgtattgatgcagctggtttgatttgccgattatctgcaattaacgcctcattggtaccaatcaatagtccgtcctcaaagcccggaatcattggtatcaaatctcgaagcggttcaaaactgattgattttattttgatgctgtcaaaaacactcacttaactaaaattagctaagtgagtgtctcgtcaactaatggccacgatgttgagcacgatgctttgccaaccgctttgctcgtatcaactgagcatggtcatgtcgggcacgacgctgctgccgcttcttcattaccaagttacgctgatgttctaacttcaacatttgcattgctctagtcggtttgaatcgaacgtgatgttgacgacattgtcgtgccgcacgacgatactcgcgaaccaattgctgctgagcaaccgcactagccgtcgtccattgcagcgttgaccaccgatcttgaattaacaacctaatctggggttcactaggattctgcgtcccaaaggtcactcgggcgacttgatacccgtccgtcgaccaacgctcaaaaacaccctgataaaattgttgatcaaaaaacaccgttaatttgcatcggttaatcaaattaacccctccttaatttcactaacgaaattcggacaaccaaggaaggcaggttactgacagccgttgctgcgtctggactaccgaccagaccgtgtttttaatttcgctaataattagtatgtcagattaagtcagtttgtcaaattagcacttatgtatcaatggaataattaatgcacttagttaatccgacatgaatcatgattaaaacgtgacagtcaatcagactcctgctcgtcagcttgggctactgagcactgtcaccctgccgctcccatcggtcaaccactcgaatggctgataattatgcctccagttagcgtggtaagaatccaccgaaaattggtgcaaactcaaactgtttccggtggatccaagccggcagttgctgaattttaaaatcaagacgttttaaccatagttattgctaaataataacgagtacaacaagtaataattaagattatattaaatggtgtaatactacactattacactgtgattaatagtatactttgtttgtaaaataccttgaagtggttattattagccgcttaaggtttagggggattccaatatgaacacaccactactgaccgtcacgcaattaaatcaatacttcagtcaccagcacattttaaaagccctgaccttcaccattcaaaaggggcatatcgtcgccttagttggtgcaaatggtgctggcaaaacgacactgatgaaatcaatcttagggctcacttcctttactggtcagatttatttaaatggtcagtcaattacgccatgccatcaccaagctttaagcgctgtgggcgccctaattgaatatcccggactctacccattcttgactggccggcaacaactctcactgttcgcaaccggtgccaatcgtacagcacgcgttaccaaaatcattgaagcacttagcatgcaagcatttgccgatatactaacgaaacactactcactcggtatgcggcaaaaattgggtgtagccttggctttgctcaatcatcccgcactagtcatcttagatgaacccatgaatggtcttgatccacaggccacaaaagaattacgcgatttaattttatggacgcaagctcaaggcaccacctttttaatttcaagtcatctcctgagtgaactgcaacgggtcgccaatgacgtcttagttcttgatcatggacaactgatcgccaatatgagcatgccagcgtttcttgcccaacagcgccccacttatgaattagtaactaatcaagatcaacgggcttatcagctattgcgttctgctggataccacctagttgcagcaacaccaattcgtgtcttaataacgcccggatttcagcttaatccattactgcaactacttttgaccaatcagattcagttacagcggattcaaccccacactgaagacttagaatcatccttattaaccatgctgaaaacggtcaaccactaaggaggtcaatctaatgttcacattgttacgacaagaaaatcgaaaattaatgcaccatcgtgtgattcaactgtttattccatttataatgatttttcaattcataattgcgatatatgccgctcactacccacagctactaacgccatatgatgcatttgtaaacaacgactacggctttattccgctactatttttggcaatcacaattggcagcacttatttaacgaatgaacggcaaaatggcacgttacgagcgctactttatcgcagttattcgcggacccaagtcttagtcagcaaatggctcacgatactcggtctgatgattggcttatctggctttagcaccctcatgagtctcggactgaagttgagcttctttcggcggttacctaattacggtacaatttggcacacttggggtctgaacatgctatcaacaggactgaccctactatttttaatgagtgtcgtcttactattgggcaccctattcaccagttcaacaccagccattctgaccggcatcattgggtactttattgtgaccattttcaatcaactttgtttttatttatacgccaaagtcagctggttaaagtggaatccgctcaacatgatcaatctaggcgagcaaatccaaacaccacaactacaacaattaacccgactaaatctatccacgctggcgattggttatatcgcctatctactgttattcttaacgcttgccaactattcttttcaaacccgtaacgtttaaaagcatccagccggtcaaataagattaatgaccggctggatgctttatcgattaattgttaatttcatcatattagcgtaactgtcgcacaacttgccaaaagtagcgactccagcgcggttgataaatccaagcaatcagaccaattaatgttgctgaccaaactactgctacatatgaccaactcgtctgtggtgccagcataacgtcggtaatcaatttagtcagtatgatgctcaaccctatcagcattggtacccgccaagccggtaacaaaatcgcttggtggttacgctccgtgatttgttgggcgctcaaataccgaccaagtatcccgcccaagccccagactagacatccaattgcgatacccaacaaccagtgttgattgaggaacgccaacaaataattaccaggttgaccgaatgaccgtatcaatacaaaccaactgattggtttaacgattgcatagccgatgagcattgccattaccaggttaggcgtgaccaataacactaatgcagaagcggtcatcaaaatcagtgcaacgagcgtggtactgattacattgccgccccagacccaccaattgaattgcgcgaaataaattccgggaatattctgtaccagcaccagcagaaccattaatttcgccaaactatacgcaatgatcgtcgttaaactatagctcaaaaacgtcgcaccaaaaatagctgctcggcgaaatcctaagctctgtaaccactcattctgatgccggtaacgtggaatggcaatgagtgctatgcccactaaaatactgattccccatagaaaatcatttggttcaacattactcccaacgcgcaaattcgccaataatccccgccgatcagcatgataaacttgtaaatattgattcaagtactgctgtttcgaaggtgctactaagccatctacatcctgatactgttgccgccggtggtcgtatttaagacctgaaattagcatgtcatgattctgatctagcatttgccagtgttgattcattctgaagccagtccacgcccccagtgctataaacaaaatcagcataccaatgagaagtggcgcatgctgccaaataatcaagtgccccaattttttattcatctcacaacttcccccagttgctggtaacgacggccagcacgatagacgagcattgccatcatagtcagcacgattctgaccaattcataccacggcgcaattgttcccatcaaaggcagtagtaggatgtccccaagtgttgagccaatactcaaactaatcaaagcactggcgataaccccattaaatagcgattgttgccgcaatgtggtgatatccgctgaccattgatgacaggccacccaagttaatcctagtagcatcagcaagcccactaatgccatgattgccgctaccccgtagtgaacatgtaaccagatactaggcaacgactgaatgtgaaaccaccgcaaccacatatttgtccgcgttaacattcccgacgcccaacgccaggtcagagtgctgatcaggattgctaaccataaccgctgattaaagctccccaccagccaagcaaacataattaggcacccactgaccatcgtcactgccacactacttcccaagagggcggccccgttacggtattgctgataaacttgggggattgcagccgtgatccagccgtaataaatcacttgacttacaaaaacggtgaccattaatagcagcccgagccgcagctgttgccaccaaatttgccaacgcgtaacacctaacccagccataaactcgaaacggtgtgtgcgacgaccctagaatgcaagcagcaaaccgctgacgagtcccaaaacataatacaaacggttgggttgttgggcccgcactgcctgattgggatccgtagaagtgtattcgccaggccaaaaaaactggtcaagatgttcataataaacatgcaggctaaccgccggacgaccggcaactttatagtctttcgggtgtttaacaaaatccgcagcgttgatccgttcaccacgtacactccgggcatgttccacctgccaagtatgtgtcacattaattgccattaataagctcactaacagacacgttgccgtcacaagtcgcacccaaggccgattttgttgccaccataaccgtctcaattttacagttgccattctacacaccaccccaaacagcttgccggtcgcccaatttaactcggaaaacatctgtaatggtcaacggctggacggccatcatcaatggttgagtttgttggagcgcggtctcaattgtcggcgtgtagtccgcaaagtacacttctaagacccgaccgtaaactttaatcagctgcccatgctctttcacaaccgctggtatatgcttatctgcaaaaacaagctgaaacttgcgggccgttgcccgtaaactttctaggtcgtaatcagcaactaattcatgatgttgcaaaaacagcacttggtcgcataaaccgtcaagttcatcaagattatgtgatgaaatcaagaaactgacgccgtgttcggcgacctcttcaaccatatagtctacaatccgctcgcgcacgatgatatccaaaccatcaaacggctcatccaaaataatatatggcacgtgactcgctaacgctagcaagatttgaaataacatctgctgacccttttataaccgctggtagtagcttttggttgataaatgctcggccgctaataacgctgttagttgcgattggtcaaagtcatcgtaagccaacgcgtatgtcgttatgatctgtcgcaaccgttgaccaccaaaaaagtgacgttgtgtatcaatataaaataatttttgccgacagtatggttgctgcaaagtcgactgcccctcaatcactaattcgccttcgtccgccaaatagtgatcagccatcgtccgaaagggcgtcgtctttccaacgccgttccgcccgaccaacccaacgattcgacctggctgccaagtaaaagtaatcccccttaatatttcacgattatcaatccgcttacttaatgctttaacttggatactcatcccgtgactccccttttgataagccgtggtcacccacgcctgaacttgctgcgcactgattcctaaaaattgtgcttccgttaacagtgattgtaagcgcgtctgaagatcatcaaccgcattcgaatcagttgcaatctgactcgattcactcacaaacgtcccccgaccttttacagtatacacggctcgctgatgctccaagatttgataagccttactgaccgtgttcggattaaggtgcatttctgacgccattgctcgaattgaaggcaattgatcccctggtcgtaagacttcctgaacgatctgctgcttaatctgcataactaactgttcgtaatacggtgccccattagttgcaaacggcattttatcacctcggtattgtgtactacgtgtattactacaattagtacactaacatactaatttgagtttgacaactcaacaatcatattcctggcacaaaatgattacctcaaacgtgagtgcgacatcattacagtatgccaaattactgaaaagagtcttaaatttggttgccagttcatcagtgcttgttcatcctattccgacctccgggacccctgctcgcatgacagatgaacggccactcaacttagtgcaattggtcgccgaattcaattactgcttggaacattgagcaaacgttaatgtggtctcagttgtttggaatctcagtcataatatggtgactgagaattaatgaacgaatcacagttcgattatcaaactgacagttactgataaaattgctgtctctaaaatagcaacgaccaagccagcaaaagttggggacatccctgtcagccattcgaataccttcccaactggaaggcatttcggccaatgctcagcactgccagagtgtgtggttcagacggcttgagactgaggattagcccaactaaggtgttaagcggtaaactcatcgcgtcgctacccggaaggctcatcggacccgaacacgtttcgtcaatatggcattaagacgtgggttgcggcttaaatcagtgtccaccacgttttaacatctacataagcaaaaaaaacgcctgaccaatcagcacctttagctggttagtcagacgtcatcatctggtgattattccaagaaatcttttaactgtttactacgtgatgggtggcgtaacttccgtagcgccttggcttcgatttggcggatccgttcacgggtcacaccgaagacttttccaacttcttccagtgtccgggtccgaccatcatcaagtccgaaccgtaagcgtaagacgttttcttcccggtccgtcaaggtatcaaggacaccttccagttgttctttcaacaattcataagccgcggcatccgctggtgaggttgcgtcttggtcttcgatgaagtcacctaagtgtgaatcgtcctcttcaccaattggcgtttccaatgaaacgggttcttgtgcgatcttcaagatttcacgaaccttttccgttggcatgtccatttcagccccaatttcttcaggagttggttcgcgccctaaatcttgtaacagttgccgttgaattcgaattaatttgttaatagtttcgaccatgtgcactggaatccggatggtccgcgcttggtcggcaattgcccgcgtaattgcttggcgaatccaccaagtcgcgtacgttgagaacttgaatcctttacggtaatcaaacttttcaacggccttcattagccccatgttaccttcttgaatcaaatcaaggaattgcattccccgacccacgtaacgtttggcaatcgaaacgaccaaccgtaagttggcttcggctaattcttgcttggcagattcatcaccttgttcgattcggagtgctaaagcgacttcttcgtcagccgttaacaagtcgacacgaccaatttctttcaaatacatccgcacgggatcattgattttaattccagaagccgagccagcgtcactaagttccttcttagaaacttttttgacacttttgaccgctcgagcatcaggatcacctttttcatcaacaacactaatcccagcatcttcaaccttttgtaataatttatcaatgccactagcatctagtttgtaaggcgctgctaatttatctgataattcatcatattgaatgctaccagttttcttatattccttaattaatgctttaacggctttgtcgtattccgtcgttgcttttgcctttgccatgtagtagcctcctatttagtatgcatctaccagctgatcggttgcaataccgagccaaccttaagtatatcattttcacgcctaattatcagctcgttggacctgctgttgttgccgatataggtcaattaatgccaacgttaactgctgaaccaaatcacgattaccgatctgcttggctgccattaactcggccttcttactgttgatttgttctaccagcggctgttgattcatgatcacattgactagatcagcaatctcttccttggaagattcattggccacgtccataaattccaaactcgtgacgacaggctgtaaatctgaatccgtcataaaatccgtaaagttgcccaaatcaaattgattatgcgttttaaaataagcctccgcatacaccaagatttgttgatacgaatcatgaacaaaatgaaaaccagcaatcgccatcaatcgtaaccaaacatcgtggtcattcaacaaacggtacagtaacaaccgctccgctttctctacccgacttaacgggccactgttcgtactgccatccaccgtggctgggggaggccctagcggcgcaggtgctggtggcggagctacttgcgtttcatccgagtgaccaccaccaccacgtcgaacggcctgctgaccgaccagtgatcgtaactgttgctttaaatcatccttatcaagatcaaactccgccactaattggtttaaatataaatcctgttcgacactagaggacaggtgtgctaattgttgcaaaaccgcctgtaaataagtcaattgatcgggcgtgttttgcaagttcaaatcatgttttaaatactgcatttcaaatgcagtgggcgtttgcttaccgtcttcaaatacttggacaaacttctcctgcccctgagcacgcaaatactcgtcgggatccatcccatcaggcatttggattacacccagattaaggcgactgttaccacctagcaatttcagagcacgatcagtcgccttttgccccggcatatcgctatcgtaacagacatataaggtgtcggtaacgcgctcaagcatgtaaatctgctcatcagttaagctcgtccccattgatgcgaccccgttctgaataccagaacgataagccgcaatcacatccataaagccttcaaacagcaccaccgacttttgttgtcgaatggggccccgtgctaagtcaaaattaaataatactgaacgcttgttgaacagcttcgtttccggactattcaaatacttaggttcattaggtgattttttgaggattcgacctgagaaagcaatcacccgaccactcgcgtctttaatcggaaacaagacccggtcaacgaagcgatcacgtaagtcacccgcttgattttcaatgaacagtcccgactgccgtagtagttggtagtcggtctggtgttctttaaaaaaatctaacaagagctgattagcaggtgcatagccgataccaaacgttttaatcgtctcatcatccagcccgcgctcgtgcaagtacttaagcgccggttcacccagttcagtattcactaaaatatgttgatacatcttagcgctatccgcgtacaactttaacagatcggcttgttgctgatccttaggtgcggccggttgtgactgcgccgtatagctcgccggcaagtcaatgtgcccaaaatcggccaccttgacgactgcttccggaaaagacaagttttcgagatccataatgaagctgaacacgttgcccccacggccacagctaaaacagtgaaaaatctgcttttgctcattgaccgaaaaggatggcgtgcgctcttcgtgaaagggacacaggccaaataaattcttaccagccttcttcaactgaacgtattgtccaataaaatccgcaatgttgactgctgagcggacttgctcaaccttttcctcgggaattcgattggccactttgccaccccatttctactaactaaagtctgacaaaccaaccaaatcattgccgcaatcaaaagccgcatcacgaaatttggatgcgactttgtgcgtgcaaacttttacagaatatatattaccacaagtttgacagcagtgcaataataagttgcccttattagacatatttgtcaaatttgtttgtcagcaagctaaaaaagaagctacagcgcgcttgctgtaacttcttttgattatccatggtccgtgcttatttaacgattaattgattcaagtcacccatcacgttgatcatttgggcgatcgtcaagagttgcttcaagtgattatcccgcaccttttcatccttactcatcaccatcgtctgttcaaagtaatcgacgatcaatggtcgtaaggcggccagggctttgaaacggtcctccatgctcatcgctgggttaaattgcttttgcaattcaagaacagcatcgtacaagtgttgttccgcttcattttcaaataaacttggatcaacagtcaaatcaccggctgccagcttagctttcgccgtgatccgcaacagacgagtaaaggcttcaattgtgtccttaaactgcggatcatcttgatgcgcattcagcacatcggctgctttgaacatttcacggatatcctgacgactccctttgataaccgtatcgacgatatcgtagcgaatcttacggttgttaaaccattgtttgacgcgatccgttaagaaatcagcaactggtgccgtttgcttttcgaagtctaagttgtacgtagcatcatgggccactaattccttttgaatatcggcctcgagttgacgaattgggaaatcccaaccttgttcccgtacgatccgtacgattccaaacgcttgacgacgcaaagcaaacggatcattagagccactaggagtcaagccaacggcaaagaagctcgtaatggaatcaactttgtccgcaatagctaacaccgcgccgaccttggacttaggtaagtcgccatcagcgctgattggcatgtaatgctcacgaatagcttgaccgactgctggatcttcacccttcaagacagcatacttgtcacccatgaccccttgtaattcagggaattcgccaaccatccctgtcactaaatcaaatttatagatttgcgctgcccggtggagttggttcttttcagtctcagtcaaaccaaaccgatcagccaaaaaatcactgataaccatgacccgctgcatcttctcatacatcgtcccgattttatcatggaagctaacctttttgagtcgttccacatattcttgaatcgagtgttgttgatcttcatgatagaagaaagctgcatcttctaagcgtgccgtcaatactttttgattacctaaagccacgttttccaagtgatccgtgttcccgtttcgaacggaaacaaagtgtggtaataagttatcctcggcatccgttacgtagaagaaccgttgatgatcacgcatcgaagtaatcaagacttcatccgggatcgttaagtatttggtatcaaaatctcccgcaaatgcagttggatattccaccaagttattaacttcttccaacaagtcttcattaactttgatttgccagtcgcgttcattcgccaaggccgcgatctgttcacgaatcgttgccttacgcttagcggcatccgcaataacttgaacactagctaagtcagcttcatagtccgcagcagtggcaatttcaacgtcatggcccaagaaacggtggccccgtgaaacacggccagccgcaacgtccagaatttgaaccggcacaacctcgtcatctaataatgacacgatccaacgaatcggccgaatatacttgaaactgtacgtcgaccacttcatcatcgttgggaaattcatcttggtgatgacatccttgattccggccgccaatacttcggccgccgttttaccagccgtaaaggtttgtacaaagacatacggggtacccttaacatctttaaagacgatgtcatcagttgacgccccttggcccttagaaaaaccaatcgctgcctttgtccagttgccatccgcatcctgagcaatcttcttagctggaccccgaacttcttttttcacatcagcctgcttgtcagctaagcctaacacctgaaccgttaaccggcgtggtgttgagaaggttttaacatcttcaaaatcaagccgggcatcctttaagaacttgaccattcgttctttaagttgcaacacactcggtgtaacgacgtgggccggcatttcttccaaaccaatttcaagtaaataagttttcgccattatttcgtctcctcctgtgcgtgttttaataacgggaagccacgtttttcacgttgcgccacgaattccttggcaatcgacttcgccatgtttcggattcgatctaaatagccggcacgttccgtgactgaaaccataccgcgagcatccatcaagttgaaggtatgactacatttaagacagtagtcgtacgcggggtgaactaagccgttcttaatttgccgcttggcttccttttcatattcatcaaataacattaataataattcttcgttgctatcttcaaaagcgtacttagaattttcaaattctggttccaagaagatgtcgccatacttcacgccatcgccccattcaaggtcaaatacggagtttacatcctgaatgtaagatgagagtcgttccaaaccataggtgatttcagaagtgacgggatcaacttcaagaccaccaacttgttggaagtacgtgaattggctgatttccatcccgtcgagccaaacttcccaaccaacaccggcacaacccattgatgggttttcccagttatcttccacgaaacgaatatcgtgttctagcgggttaatgccaagtttttccaagctttgtaagtataaatcctgcacgttttctggtgagggtttcatgaccacttggaattggtggtgttggtacaaccggttggggttctcaccataccgaccatcggcaggccggcgtgaaggttcaacgtacgccgcgttccatggttcgggaccgattgcccgtaagaacgtgtaggggctcatcgttccggcccctttttctgtatcatatgattgcattaacatacaaccttgatccgaccaaaacttttgcaaggttaagataatctcttgcactgataactttttgctcattagtatcctcccaaaattagtgactgaacggctgatggctttgaaacgggggcatcgctattcccagacttatggcacaaaaaaagtcccctgtcgtcgacaataacgacatagggacgattggtttcgcggttccaccctacttctgagtaacctcagcagcttaattacacggtattaaagctccgaaagcgccaattaacgactttgactgaccgtttttcaccatcacggtctcactgtaagtcgaatccgttaaccttctctcatcaacacttaactattcagttcttcatcatcatagctgatggtcgttcgtttgtcaatcctcattcttccggggcgccaacggttggtaccaactgcccatctgatcgatgaagcgtttagatttcaatcgaacgcccactgagttctgatagatttcatccaaaatccggcgtaactccgctgctgtccgcggtttgaccttgatcgaatgaaccttagccaaatccaacacggaaaactgacgtagataaaagatcgctgctggactagcatgcaagcggtggggatccaaatgccagtgctgttgacagagcaaaccgccgtaactttcagaataatctaacggtaaatcacttcgaccgcaaaccgtacaccaacgcaactctggggccaccccaaacggttgcagtaactgaatttcgaccacgttagccaccaacgcgggggccacatcttgatcaatcagttgcagcgcactggtcaactgttggtaccaccgccccaccggttgattatctggaaaagcgacgtccattaagttcataacgtacgtggcataagcgttcaaagcaatatcttgactaacatgttcaagatactgtactgacttgacactattaatatacgagagaccttgatcacgtaaatcaccaacatattcccccatcgtgaacggcaataactccgccgccattttgaagccacgccgacgcgcaccgcggataaaaaacatcttcttgccatactcggcagttaaaaacttgattagcatatcgcgttcccggtagtcccggcgaaagagcaaaatgccgttaaaattcgtgaccatttgttgggccatccggatcacctagcgattctaatagtcatcttgccgatagccatagctggctagcaagtcttgacggtccttccagttctcttggacttttacccagagctcaaggtagaccttatccccaagtaagtgttcaatatcacgccgagctaacgagccaatcttcttgagcatgctaccacccttaccgatgatgatgcccttttgcgaagaccgttcaataataatcgtggcctgaacgtgaattttttcttcatcttgacgtttgatcgaatcaatcacgaccgccgttgaatggggaacttcttgacgagtcaattcaagaaccttttcacgaatcaattcagaaatgataaaccgctctggatgatccgtaatttggtcggacggataatactgcggtccttccggcaattggcccttcaaggtcgtcagtagttcatcaacgttatttccttcaagcgcggaaattggataaacttccttccacggcaaagcgtctttatactgatccataatctccaagagatgatctggatggacttgatcaattttattaatcactaaataaatcggttgtttaaccgttttaagacgatcgataataaagttatccccggcaccacgccgttcgtccgcattaatcatgaatagtacggcatccacttcacccaaagttgacaaggcggacttgaccataaagtcacctaatcgactatgcggtttgtgaatcccaggggtatcaatgaagaccatctgcgtatccgcagtggtataaatcccctggatacggttccgcgtcgtttgggctttgtcagacataatggcgactttttgcccaacgacccgattcaatagtgttgatttaccgacattgggacgaccaataatcgccacaaagccggaatgaaatgcttgttgttctgccataattaattcctttcaatcttgtccaatcgttaaccaattactagtttaaccaactgacaattaagttccaaattttaggtgcaaacaacactaacccaactaagacggcaaaggccgcggcaaacactaccgcaccagccgcaatgtccttaatttttttagctaggggactgaaattaggcccagtgatcatatcggacaggttttctgcaatcgtattgttaatttcacataagatgaccagaaaaatcgctaatgctagccacagccattcgttaacgctcaagtgaacccaccagccagcaaacaaggccaccacccccagtacaaggtgtgttcgcatattacgttcttcaatcacaaccgttttaagcccagtccacgcgtgtagccaggactgccaaaacgagtgatttttgccaacctgtagccgatctggtctatttttcgaggccataagcgtccaaaatctggcgttgcaatgtaaacatttcggtttcatccgctggctgaagatgatcatacccatttaaatgtaaaaagccgtgaacgaccaagtaacctagctcgcgcgcctccgaatggttcaaaaaagcggcttgttcgctaaccttatcaactgatatcataatatccccgagatttagtggcatttccgccgccatctccggatccatcacaatcaaatcatcctcgtcatcgtcgtgcatcgcaaaactaataacatcagttggacgatcgacaccccgatactgttcattgattttttgaatagcatcgttattcatcagggtcaccgagacctcggtatcatcccgtaactttaacgtctgaccagcaagatcaattaaatcccgaatcaattgcaactgttctggctgcgctcccgttgttgtttggtcgtataattctaaatccataagtgccccctagcgttgttccacacggtcgtacgccgtaataatcttggcaacgaccggatttctgaccacatcatccgccgtaaacttaacgaacgcgacattgctaatgccgcccaaaatctgttcggcttgaatcaagccactcttagtatggtgtggtaaatcaatttgtgagatatcaccattaacaatcatcttggcaccgaaacctagccgcgtcaaaaacatcttcatctgggcattcgtcgtattctgtgcttcatccaagatgacgaacgcatggtcaagcgtccgcccccgcatataagccagcggtgcgatttcgatgataccacgatccattaagcgctgggtatgttcagcgccataaatatcgtacaacgcatcataaattggccgcaggtacggatcgactttttcctttaaatcaccaggtagaaaaccaagactctcaccagcttcaaccgctggccgcgtcaaaatcagcttctcgacatcgccccgttttaaagctgcaattgccatcacaacggctagataggtcttcccagtcccggctggaccaataccaaacgtaatatcacttttagcaacggcttgcacatactgccgctgaccaaagtttttgacacgaatgggccgtccacgattgtccttaattaaggtctctgaatagaggtctttaaagtaatccaaagtcccccggttgaccatcttaatagcgctaataacatctggcgccccaatctgaataccttgtttaattaaactcgttaaattatctagtactgcttgcgtattatgaacagcaacctcgtcatcactgctgatcgtcatttgatccccaaacacgtgcaattgaacgtgtaacccatcctcaagcaaagctaagtgggcgtcttctggtcctaataacgcgactgactgggccggatcagcaatgagaaatttttgttcatattttgagttttcggtcaaaaacatggactcctttattgacagatttaatcaccattatttaataatggcacccgcagttagcgtgataaccacgctgatttcagcaggtatttgttagttaatcatagcataaaagcccccatcgaaccagtacaaggacgcctcgacattcgacaacgattttctgaacagcatttttctttcgagcgattaaattggcacgctatcaatcaacgtaagcccagttagatcagcccctgcacccattgctgatacttaatccgaacaaccggtactgcatttatgatcaaccagaagaaacaaaaaaaccggagaaaaatttctccggttaaccgttaattcaataatgatttaactgtttggttgatcagcttgccatccgcctgacccttaagttttggcatcactgcccccatcaccttgccaaagtcacctttaccagtagctccgacttgttgaatggtgtcagcaacaatctgttgaacctcttcgtccgacaattgttttggcatgtactgctcaacaattgcaatttctgctttaacgccgtcgactaaatcttgacgacccgcattttcgaattcacttaatgattcgcgccgttgtttcagttcacgtgagagcacgcttacttcctcatcagccgttaaatcatggccaacattaatttgttcattcatcaatgctgacttaagcatccgtataacgctgagggcttgcttatcgcgtgccttcatcgcagcttttagatcaccattgagtgtatcgattaaactcattggttttccctcctcgttaggtcattagtaatcaatactaattacttgaaacgacgacggttcttacgcttacgtgctgcttcagattttaacttcttcttcacacttggtttttcgtagaattcccgtttgcggtattcttgtaaagtaccactctttgaaacggtacgcttaaagcgacgaagagcatcatcaagagattcgtttttacgaacgactgtttttgccatgttaaattccctccctccgagctcaaaaagtaaccgttaaattatgcatacttacacataacgcaactgttctagtaaattatacataaattgaaaaaggccgtcaaccaaagtttacaatttccttaaaataaattgttaaaagcaacgtcagttcggacagtaaatcgttttcatcacccgccagctatgctacactaagactattatcgaaccgaaatgaggttattctatgtcagcaattaaagtctttattttatctgattccatcggtgaaacagctcataacgtggccttagctgccgctgcacaattctccgattatgacattcgctatcagcgtttcccatttgtccgcactgactcactgctccagacggttttgtcgcaggcactgaaggaacacgccgccatctttcatacgtttgtcgatcgccggctcagccaaatcgttaaccaattttgcgaagcgcacgagttgccttattatgacgtcattacaccagctttagatactttttcacagattacgcacgtccaaccgtccaatcaccccggtaccgtacacgcgttaaacaccaactacttcgaccggatcaacgcgatcgaatttgcggtcacttacgatgatggtaagaatccgagtggctttttagaggccgacgtggtcttactgggtgtctcccggacctctaagactcccctgtcactctacttagctaatcgtaacctgaaagtcgccaacttgccactagttcctcaggcccaaattcctgacgaaatttggaaagttgatccgaaaaagatttttggcctaactaacgatcctgaaaagttaaacgatattcgccgacagcgaatggtccaatatgggcttaatcccgacaccatgtattccaacacggataaaattaaagccgagttggaatacgccgacaagatcttcaaaaagattgggtgtttagttatcaatgtcgctaataagtcaatcgaagaaaccgccactttaattaccgaaagcttgaatactgacgacactaacaatggctagtatcactaattgccaactcaccgatgccgcctaagttttcctgacaatcagcgcgtgccaccttttaacggtcagcgcgcgcttttttgcatcatttttcttatcattaattaggtcagctactaatcatcagtcgtgtcactcacacgagctcgacaccaccgtcaacgtgcaacacttgcccagtcataaactcattttgcatcaaataaacatacgccgacgcgacttcggtgggcgttgccacgcgtttcaagggattaccagcactgacggtcgcagcctgggccgccaattgtgcgtccgatagttggcgccaaagaccagtcggcgtccaagtcggtgcaactgcattgacgcgatagtcaggcgccaactctacggcaagtccaacgaccatcgtattaatggcttgattgccaacaatcgctccggaggcattatctggccgcccaccagcacccgaagtaaaaatcagcgaaccgtgttggttaagatggtggctggctaattgggccacttgcagatttgcaaaaaatttatcttcaaccgtctgccgaatcgctgcaatcgaattgtccaagaaccccccacccattgcgccacctaacattgagacgacgtggtcaaatacaggctgagctgcaaaaaaagtttttagttgcgccagattttgtgcgtctaacgctgttccagccaaatggtctgatgggcctaattgggtgatggcagctgttacgtgcgccgccgtatgaccgataatatggacatcggcgccttcctgtaaggcttggcgggcaattgccatgccgaaacctgaagtaccaccaatcactaatagccgctgttttttcaattgcatcgtcattttcctccttctaaaacaaaaaacgacaaccgactagcgattatcgttcaattctcattaacgttgctgttcaatatcttcaatcaaatgcggattaaactccccgacccgaagcattgcaatctcatacttataaggtggcaattgatgtttcttatcttccccgacatacggcgtttctaaaatcttgctgatgtctggcaattgcggatgatgggcgaccttattcaaagtatcaaagccaatcgttcccataccgatattcgtgtgccggtccttgtgagcaccttgaggattcttagaatcattgagatggatcactctcaaacgatccagcccaatcacatgatcaaattcattcaggacaccgtcgaaatcgtccttaatcgcgtaaccggcatcactagtatgacaagtatcaaaggtaaccgataatttttcattataagtcaccccgtcgatcatctgcgcgagttcttcaaacgtccggccaacttcagttcctttgccagccatcgtttctagcgcgatttgaacgtgctgctctggccgaataaccgcgttcagtcccttgatgatctgcgcaatggcaacatccgctccggcaccaatatgtgctcccggatggagcgttaattgtgttgcgccaacggcatctgcacgctggatctcttgatagagaaagtccgttgcaaactcaaaataacccggctttttcgtattacctaaattaatgatgtatggggcatgtacgacgatctgccggaggtcatgagcctcgattatcggctgtgcttcgtcaattttcagttcgtcaattggtttacgccgtgtattttggggtgcgcccgtatagatcataaatgtgttggcgccgtaacttgccgcctcattggcagatccgagcaacatgtcgggtgccttcatcgaaacatgtgaacctaatctaagcatcgtagtcccatccttttcgcaagtttactaattcctgtcataccttaaagttgccggatacatatgataccggcatgatcactcattatccaaataaatctgtcaagtcatcctaagcggttttggtcaccgtggataaaagtacgccaaggtccgctcaatcgcatgaccgtcattacgcgtattccataactgattaaactgggttaactgtaacggcgcacccggcattgctaggacatgattcaagtccaccaccgtccggactaatggtcccggcgcccagtccctaaaatcagcttgcaggcccacttcttgctcatagtagtcccagtcaaagacataaaaaacgattttttgacaatttggtaacaacgcgtagtcaaacacaactgaggagtagtcactgaccaacgtattagcgaccgtcaacaattcatcggtactaaactcaggtaccaatgtcactaggtccgggtaacgggcttgcaaatcacgttcctgctcggccaaatggggatgtaacttaataatcaagtgttggtcgggccgcaactttaattgcttaaaatcagccggcaacgcaaattgaacaccggctcgataagtcggcgcatacaaaataacttcctgttgtttaaacgccggatacttctgataaatggccgttgcggtttgcatcacccagtcggacttacaataccgatccgaacgaggatatcccaagacccgcatccgcgtctgtgggacgtgataactcgctgcaaaaatcgttcccatcttctcagaaccaaccacgtaatcagtaatctgatcatacacggtctgaaaccgacgccgatcatctgcaggccgctgtgccgtctgtggatcaccccaaccaaatgttttgaccgcacccgcagcatgccagagttgaatcagtcgttgtggggcctgccgcgtcaagccagcggtaaagccataataattatcaagataaacgtccgctgcccgggtaatgacgggaattcccgtcaaggcaaatcgaactgaatcatgaaacggccgtgtcgcaattcccgcctgtgccagttgtgccgccccggtggccgcactcggcaagtaataaacagtcaagcgcccggggacgcgctggttcaactgctgaataaaatccaaattgtccgcaaagctcatcaaataaatcacctgatcattttttctaaagtgcgctagccacgagacaactcgcaccagccagacataaattactttcttcacactggccatcctttcatttcatcattaattattggtaaagcgtgccctacgtgacaatcaaaaatgtgccagctcaattacgcttaaaaagttcagattagcgtcaacttacttaagccgtctgccttagtccactaaatataaacaactatttttcaagtctgttccccattagttgttcattagctctgggtctaactgatatggacttatgatccagcaataacacaatgcttgtattatataacagatgcccacacttcggctagtcgggtcactattaatagtggtgtaaaagtcggccccgaacgcctaatcaaaaagtgcttgcaagcaaggcccgaaagtcctgtttgcaaacacttttaatctgataaattcatcaaggcttcggttcataaaagtgaccgagaatcttgaccgtatctgaaatgctaacgaaagcgtgcgggtcagattcggccatggccgccttcaactcgcccatttcgtaacgcgtgatgactgtaaataaaatcgttttatcatcatgttgataagcaccttcagcgttgtgcacgatggtaacgccacgacgaatccgattttgaacgctatcaatcaccgttttagggcgactcgtaataatcatcacttgcatcttctgttggcgcgtatacgtcatatccatgacccgaccattcacaaacaatccgagtgcggaataaaaggcatatggccacccgtaaacaaagccagccgcaatgacaatgatcgagttgaacgccatgttaatcgtcccaatactgcgacccgttttacggcgtaacacgataccgataatatcgagtccaccggttgaaatcccatttttgagggccgttccggtcccgaaaccattaacagcacccccaaaaatcgcacaaatgatggggtcatgggtcaaaccaactggggcaatcagtttaatcataatactagatagcgtaacagctaagaacgtatacaacgtaaacttatgcccaatcgatcgccacgcaataatgaacattggaacattcaaaataaacagtaacgccgcagttgaaatctgaacgggaagaaacttgctcatcaaactattgatcaattgcgcaagcccagtgatccctgaagaataaatatgccccggcgtccaaaagtagttcatggcaatggaaactaaaatggcgtatataaaagcagttgacgctttcacaacatcacgatggtgtttggataactgctgaaaatcatccatgaattaagtgtgctcctttacgtttttgctttcgttattgtaacacgccgatttgcaaacggccggtcttttgcagtattctgctaaaagtctcacgtttctcagcaaactcccattaatcaatccgactaaattccagaacgagccccgctacgatagttattgttagatcacacctatcgcgatgaccagcaactcacgcttagtccactttaggtgcatcggcccactgctcggcgatgaaatcagcgcggccacccgcttcttgttccgcaaataccactggattatttttataaaagcgttggtggcgtgcctcggctggataaaatggtttggcatcctcaatcgccgttacaattggtttactaaatcgttcgctcacctgtaatgcccgtttagacgcttccgcgatccgccgttgttccggaccattcacaaaaatgaccggccgataattatcaccacgatcttgaaattgccccattgcatcagtaggatccgtttgatgccaataaatattgattaattccgtgtaactaatgatatcgggatcaaacgtaattttgacagcttcagtatgacccgtcgtatgcgctttgacgtcttcgtaagtgggatttttcgtgtgtccaccagtataacccgagacaacactgtcgattccgggttgactatcaaaaggctgaaccatgcaccaaaaacatccacccgcaaaaattgctgtttccatgagaattcctccaattaaatattaatataaatttaacactaattaaaaagaacgtccattcctggacgctcttaatatttttattcggttggttcatcatccgttacgggattggtaatattcaaatccaaatcagctagttgctggtcagaaacccgcgatggtgcattggtcattggttctgacgccttggaattcttagggaaggcgatcacttcacgaatgttgtcgttacctgataataacatcgcgaaccggtctaacccgattgctaagccaccatgaggcgggaagcccatgtcaagggcatccagtaagaacccaaattgttcttgggctcgttccttagtgaagtccaatgccttgaacatcttttcttgtaattcgcgggtatgaatccgaatcgacccgcccccgagttcataaccattcaagatgatatcatatgattgtgcatgggctttgtgtggatcttcgccatcattcaagtaatgaacatcttcttcattgggcattgtgaatggatggtgggctggtacccagcgctcgatgccttcatcatattcaaacaatggccagtcaacgacccataggtaagcgtattgatcttgatcaatcaagtcaagttccttagcaatcgcggtccgtaagtaacccagcgtgtcagaaactactttgaaactgtcggcggcaaacaataataagtcgcctggtttagcagcagcagcactcgtaatggcttcaaagtcaccatcgttcttgaagaatttcgcaacgggaccactaaagccgtcgtcagtgaccttcatccaagctaagcccttagccccaaaccgtttaacgtactccgtgtacgcatcgatttgctttctagaatattgatcagcaccgccaggaactgcaatcgccttgaccaggccaccattagcgagtgcattatcaaagactttaaaaccggcgttagaaacggccgcgcccatgtctttgagttccataccaaagcgcacatccggcttttcagaaccaaaacggtccatagcttcttgccaagtcatccgcgtaaacggcgtcttgatgtcaacacccttgacgtccttcatgacttgcttaatcaagccttcagtataggactgaatttcttcagccgttaagaaggatgtctccatatcaatctgggtaaattcaggctgacggtcaccccgcaaatcttcatcacggaaacagcgtgcaatttgatagtagcgatcaaaaccggcccccatcagcaattgcttaaagagttgtggtgattgtggtaacgcgtaaaaatgcccttgatagacccgcgaaggcactaagtaatcccgggccccttctggcgtcgacttcgttaagaacggcgtttcaatatcatagaacccgttggcatcaaaatagctatgaactgcttgggtgatgccattacgaattttcaatccacgttgcatttctggccgacgcaagtccaagtaacggtacttcaagcgcaattcatctgatacgttaatgtcatcttgaatataaaatggcggggttttcgccttatttaagattttggcatcgtgaatctcaacttcaactttaccagtcttcatgcggtcattaacagcgtcagcattccgattaacaacggttccttgcacttcaatgacgtattcgccccgtaactgatctgctaccgccaaagcatccgctgaaaattcctgactaaagactaattgcacaattccttcacggtcccgtaaatcaataaaaatcaaactcccaaggtcgcggcgtttttgtacccaaccttgtaaagtgaccgtttggcctaaataatcctcattgatgagacccgcatatgtggtccgtttcataaacgcttcctccttataaatcggcaaacttgccgttcacactacttatctaaaacttgatgagcatcttgatagatgtccgccatcgcaaccttggtttcctcacaagtagccatagccttcaagttaacgacctgatcagccagctcggtttcgcccaccgtcatcgtgtaacgggcattcaagcgatcagcactcttgaactgagctttaggcttgcgatccaagtaatcccgttcggccttataaccggctgcccgtaatgcctgtaccagcttcaaagtcgtagcactagcagtgtcgccaattcccacaacatagacgtccaactgatcatcagttggtaccgcaatgttttcagcatccatcaacactaatagtcgttcaacacccaggccaaagccaacacccgaaacttcagggccacctaattccttaaccaatccgttgtaacgacccccagcacagatcgtcgtgtagcccttgcctaacgcttttgagtgggtcataatttcaaaaatcgtatggttataataatctaatccccggaccatcgtggcatcaatctcgtacggaattgctaatgcatctaaatacgtcttagtttgatcaaaatgcgcttgagcttccggagacaagtaatctaaaatcgatggtgcatcggccacaaattgttgatcttccggtgccttactatctaaaacccgcaatggattcttgtgtaaccgttccttggagtcatcactcaattcatcaaagtgtggttccaaataatcaatcaaggcttgtcggtaatcatcacgcgtttgttgatcacccaacgtgttgatgaccagtttcaaatcagtcaagccaaaggttttaagtaagttatagcccattgcaattacttcaacgtctagggcagcactttcactaccaaaagcttccacgcctaattgatggaactcacgtaaccgacctgattggggccgttcataacggaacattggtcccatgtaataaaccttgtatggtttgagaacttgcggaccgtacaacttattttcaacgaacgcccggacgacgccggcagttccttctgggcggagcgtaatgtgccggtcacccttgtcatgaaaatcgtacatttccttcgtcacaatatcagaagtatcccccgctgaacgtgagaagacctcgaaattttcaaacatcggtgtccggatctctttgaattgataagtcttgaagacggcacgagccgttgcttcaacgtattgccacttttcactatcgccaggcaaaatgtcggcggtgcctttaggccgttgatatctcattaatagttcctcccttgattgcaatcgacaaaaaaagcgcccttgattatttttaccaagggcgctattagcgcggtaccacctttttgagtactaattgataacgtctgtaatcacaggcggaacgctgccgttcacctcaaaagcgtctcctcattgcgcactatccggaattctcagcactaccggtctctggttatagtggcgtacaatgctcttactttctctgcggtcgattgattaatatgtggttaaagttacacgaaaatcacttaaaagtcaacgattctagttaaaattatctcaagatttcgtcggtcagctgtttttttggtatactatttgcagcacttcaaattgcaattatcttaaatctagttggtgacagagcatgcaagttttaaaacaattttggcgtcaaatcacagtcacggttatttttatcggcctagtgattggctttgtagtgctattagcgactaataacactgcgactgttaacattgccaacgtcaatattcgtagcggtccaggcatgagttatgcgatcgaggacgctacgtctaagggcaccaaggtccacattatgaaacgcaaaaataattggctatacgtccgttatgcggatcataaattcggctggattgctagttggttagtcaacgaacataacagtcagttgactaaaaccaccaaaatctctgaagccaccatcgttttagatcccggacacggcggttctgattccggggcgctctcgagcaagggcaagatggaaaaaacgtgcacgttacgggtcgctaaagctgtagctaaaaagctccgggctgctggcgcacacgttgttttaacccgtgattcagatgaatacgtcggcctgagtgcgcgtcccgcaatcgcaaacaagcttcatgcagacgccttcatcagcttccactttgacagctcaccagaaaaaaacacggcttctgggatcacgacctattactatcataagtcaacctcactagcactagccaaagcgttaaacaataacgtctcgaccttgccaattcctagtaaaggaacggacttcggtgactttctggtcattcgtgataattcacgaccatccgtattgatggaactgggttatattaatgataagtcggacttcaagacgatcagttctaaaaagtaccctcaagaagtagcgcacgcggtttacgccggattgagtacctacttcgccaatcaataataatgcagtcagcatgaagtctttgaaagtggccgttattccagtgactgggataacggccacttttcgcgactattcaatcgatgaatcgcatatcaactgacgcggtttacctaaataaccgtctatttgcctgcactttagctccgtaccggacgtctaacctcatttcacactcttacggatcaacgccactaattgttaataacaattaattgcgttacagtgatggtaaccgtatttaacatcgcagcaaggaggagttaacatgcacttaacaaaaacttggctcgcacaactaccactcactgacattcagcaagtgcaaccagtgagcggtggcgacatcaacgcggcctttcaaatcatcacccgtcatcaccaatattttttaaaggtccagccgcacaacgacgttactttctttgaccacgaagtcgctggattgcgactacttggtgcagtgactaagacaccgcgtgtcatcgccagtggcacgattgccacagacggttatctcttattagattggctagcgaccgggactggcagtcagtccgcactgggagcggctgtcgccaaagttcaccatcaacaccacgcccaatttggtcttgaccacgacttcacagctggcaagttaccgaaaattaatcattggcagactgattgggcaactttctatacacaacaacgtttagatgtattagtcaatttggctaaggagaaccatttatggtcagaaacgcgtgaaatacattatcaccgcttacgacaacaactgttgcaagattcccacatgcatacggtaaaaccaagcctgttacatggcgatttgtggtcaggtaattacttatttgacacgaccggtacacccgttttgatcgatcccgacgtgttttacggtgaccgagagatggatctggccatgacgacgatttttggtggttttgatgctgatttttatcaggcctaccaagcggcctacccggttgcgcccggtatgcaagaccgcctaccaagctaccaactctattatttactggcccacctgaacctgtttggtgaaacatacggaccagccgttgaccgaatcctcatgcaatattaatacaagcctcgtgaccgaatcctctcaatgagctgtacgggtcgcgaggcttgtatataattttttagctacaatcatcagttatcacaatatttcgagtgtctagactagtcgacaaaggtcaataagtcgtttaaatccgtaacttgaacttccggggcactagtcaccgtaatcaggcggtcaatatcaaataaatatccggcaatcccagcattgtgaccggcatcgatgtccaagttgcgatcccccaccataacggcgcgttgacagtcgacctggtgtttattcaataaataattcaacgcagctggatcaggtttacgtgggaatggctgagcagccgtgaccgcatctgtgaaatattgggctaaacccgctcgttgtaaataggcttgtgcgctttcgtcacgatgggtcatcaaataattgtgaccaccaactgcgataactttttcaagcaccgcttgagcacccgcaaaggcggccggtgcatgctgtaattgtggctcccaacgttgatagcccgcccgtaaatcatgccaatcccaaccatactgagccgcaaccattctttccgcataaccaactgactgttgccgcatcagctggtacgttgtatcagccggaatagtcccacctaactcggcaactgctttttggaaagcttggaccatggctggataagtatctaacaaggttccatcgaggtcccataaaaactcacgcatctcattcactcccgctaataattgtaatagccaaaaagctgaaagtaccggattggtctttcagcttttacttcaacgttgatcagtatcataacaaatcgtgaccggcccatcgttaaccaaggaaacttgcatatcggcaccaaattcaccagtcgcaacggtcacgccactggcagctaattgctgattaaatgtatcatacaatttgctagccaattcaggattacccgccgctgtaaaacttggtcgattaccatggcgcgtctccgcgtataacgtaaactgcgatatcgacaagattgctccaccgacttgttgaatattcaaattcatttttccatctgcgtcactaaaaacacggaggtttaaaatcttatgcgcgatgtaatccaattcggcttgaccgtcgccatcttgaaaaccaaccaataggacgaaaccgtggtcaatcgtgccccgaactttcccatcaatactaacttgtgcctgctgtgaccgctgaacaatgactcgcatagaagcctcctaaaacattttccgttcgacaacgtaaagatcctgaacatttttcagactgtcaatgattcgttggagatgttccaagttgcgaacccccaacgaaacactaataatgaccatcttgttgtgatcgaccttaccgttgacattggtcaaaaatttcgtgtgattattgataactttcaacacatcgttgagcatgccattacggttataaccttgaatttccaaatcagaattgtagttcgttcggtcaccctcgggattctcccactgaacatcaatcaaccgttcaccatttgcttctgcgctcttaacgttcggacaatcaacacggtgaaccgaaacaccgcgccccttcgtaatataaccaacaatctcatcacccggaattggagaacagcaatgacttagacgtacgagtaagttgtcgacgccttgaataatcaccccaccagaagatgagaccttttgccgcttccgatcctgcttctcctgatcctcattatgatgatctttcgatttcttcttcgctggcgcttccgtagagtctgccaaaatggcctcctcacgttcacgctgccgattagcctcgcgctgtttacgaacatcactcgttaaccggttagcaatccctaccggttggacgtcaccaaaccccaaggccgcgaacaaatcatcctcactaccgtagtgcatcttttgagcggccgccgtcaccttgtccttagtcatgatttcttttggattaaactctaaatcacgtagctgcttctcaagcaaatcacgacccgtaatgatgttttcctcacggtcagcattgcgaaagaactgtttaattttattacgggcccgccgcgtatagactaatttctgccaatcacggctaggaccagttgaactagtggacgttaaaatatccacgatatcaccatttttgatttggtaatccaatggaacgatcttgccattgactttcgcaccagtcgtatggttacccacttccgtatggatcgaatatgccatatccagtggtccagcgccctttggtaattctgtcacgtcacccttgggcgtaaaagcatagacccggtcactaaagaggtcgcccttgacgccctccataaagtcggcagcgtccttactttcatcctgtagctcaatgatttctttgactaagttcaacttgttgcccgactgagtctcttggacctcgtcgcgtttaccttccttatacgcccagtgtgctgcgaccccgtattcagcgacccggtgcatttcaaacgtccggatctgtatttcgaggggcttaccttcaggaccgaccaccgtggtatgcaaagattgatacatattggccttgggcatcgcaatataatctttaaaacgccccggcatgggcttccattgtgtgtgaatcgcacctaaaactgcataacagtccttgattgaatccacgaccacccgaattgccagcagatcgtaaagttggctaaactgtttgtgtttgtcccgcatcttcttataaattgaatagatatgcttcggacgaccataaatttcagcttctggtagttccagatcatggagcgccttttgaatgtcttgaatggcaatctcgatgtacttttcacggtcctcacgccgcgaattcatcaagtggacaatgcgataatactgttgaggattcaaataacgtagtgaaatatcttctagttcccatttaatcgtgctgatccctaatcgatcggcaatgggggcgtaaatttccaacgtttcatttgcaattcgccgctgtttatcgggccgcagatgctgcaatgtccgcatattatgcaagcgatcagctaatttgacaatcatgactcgaatatctttagacatcgccaacagtaatttacggtgattttcagcaagctgttctttgttggacttgtaccgaatcttacccagcttggtgaccccgtcaacaataacggccacgtcatgaccaaacagttcttcaacgtctcctaaagtaacaccagtatcttccacaacgtcgtgtaagaaacccgaagcgacggtttcagggtccatcttcaattcagctaagataccagcaacttgaatcggatgcataatatacggctcaccagattggcgatactgatccttatgcacataagttgcaaaatcacacgcccgtttaactaacgcgacgtgatcactattcatatacttttgaaccatgtccaggacatcctgggcagtccaggtaggttgtttgggcattttatcaccacgacttccacaaagattctatttaataaaaggcacgtgaggttcccacccaacgtgccttgacaaccgttttaacgcaaactcgcgcggggaccagttaacccatatgctaagtaggatatgcctaaatcaactaacgctaagtaatagacatacgttgggaaaaatagatagagcccgacaaaacagcccactgggaatagccagactaaccagcccgtccgttcagtccgacgaatccaccagccaacgactgctgccagcacaaagtcaactacaaagagtagccatacaatctgatgaaaccggctaatactcgtaaatcgtagcaaccatggtatcatcaccccaacgacaagcgcaatcagccaataatggccattaaacttacgaattttttccgtcaaactaactccctcgcttacgctttattgctaaatgactatgattatttattgtacaccaccgaccgcaaaattacactagttcgcaccaaaaagaaacgctacttagtaagtagaggggtgccgtttcggcccgcatgattcgtggacccaggcccactgccgcgataccagcagtttgtaatgtcgccacttcttgtggtgccaagcccccttcaggaccaaaaatcgccagcagtcgttgtggtgcggtcatcgtttttaacgtctgcaccagttggctgctctcaccttgtttggctgattcctcccacgctacgaccccggtatcatatgacacgtgtgctaacaactggtttaaatccgttgcgtagctcacactaggaatcatcgtccggtgtgactgttcagccgcgccctgcgcaattttcgccaagcgggccaacttgcgggcccgcttattcgctgcccatttagccactgcccactgactatcgaaaaacacgaaggcgctcgcacctaattcagtaccacgttgtacgatctgttcgggtttatcgcctttagacaacccacaagcaatagtcactggcaacggcaattcaacatggggcgtcgtaacggccgtgattgtcgctgtagctgttcgaccatcgcttttcaccaaatccgccagcacgacttgatgtgtcgtcgtaacaaattccgcagtgtcccccggttgtgcgcgcatcaccttgacccagtgtttgaccgtctcacccgtgatagtgaacgtttgcccaatcgttgtcgtaatcggtgttgataaaaagtatcgttgcatttcagtcccccactaatcttcagctgttggtagataagccacaataccgtgccagtcacccatttgcgtatgttgtgtaatttggaagcccgcttccttaattgtcgtcatgacgacctggaacttatcatcgatgatgccagaggtaatgaaatagccgccccgttttaagttttgacgggcttgtggtaccaacggaataataatttcagccaaaatgttggcaacgataatatcagcctgcgtgtcaatcccagctagtaaatcattggcagccacgtgaacatctttggcaactggattcaagtccaaattcgtttgagctgatgccacagcgacatcgtcaagatcgtaagcttctactgcaccgacgcccatcgctttggccgcaatactcaataccccggacccagtacccacatcgatcaagtgttcaccaccattgatcacagtttcaagcgcctgcaaacagagcttggttgtcggatgcgttccggtaccaaaagcctgaccaggatctagtcgcaacacaagctcacctgattgcactggttggtactgttcccaacttggcacaatcgtcaaatagcgcgtaacccggacggggtgatagtattttttccaggccgtcgcccagtcttcatccgataaagccgtcatactgacttcattaggtgctggattcaacccaaaatcagtcagctgactaacccgctgcttgatcgttggaatgacttccggtacaaacaccgtctcaggataataagcagaaatcttcgccccactggtaacgtgtggaatcgtcgccaaatcgatgatctcaccataccgatcaggctttaaattctgataatccaaggcatcatcaattttgacgccactggccccggcttccattaaaatgtttgccaccgcttcgacagcttcattagaagtactgaccgttacttcagtccatttcatatctttatattttcctcccatcgaaagctagagcgccaagcgccatcgcttaagactatcacgtttttcttagtaacaattatataacaagcctgattaacttgacaatcacctggtcatccaaccatgatgttcatgatcgatagtccggcgagaaatcttggatacgaatggattgccggccacaaagtaccgcaatggtgccgttgtccattcacccttgttgacaattccaattcgcggagtcgccacaacttgttccggttggcaataatgactcaaatccaatgataaggtcgccggttgcagtgattgtccatttaacgttttatctaacccaagtgcctgcattagcttgcccggtccgttggtcaagttcgcaatgggcactggccgctgctgttgcattcgttcaagccccgcatctggttcaattccgcgaatcaagacacattctggcgtaccggcagcttgtgtcacaatattcagtaagcaccaggccctcatttgataaatataaattgttcccgctgattgccagagtgcgtgattgcgcggcgtttggtggttctgatacgcgtgagctcctgcatcacgggcgccaagatacgcttctgtttctgtgatccaagcggtcaatacaccgctagatgtctgtaggcgcaactgtttacccagtaggctcaccgcaatttcaggtgtcgtgcgtgtgcttaaaaatcgttcgattgctgtcataacttgttttactcgcccctaatagaaaacggactagccaccttgctagtccgtcctcatattcatttaatcattatttgcggtctttttggttagatgcttattcaaatacttaatcatgtcggcttcatgcttaaagatccgcgggtgcttttgcttgtgcaaccgaaccgcgatctcattgattttgattcgcccggtccaagtatgactgtacttaacgaccacccgattgttgcgatggtccttaccgaatttcaacacgtaaacgctgtcgggcaccatcagcggtctaatatatgttttatcgtagtcataatgtattgatcgcagaaactgtttcgtgcgttttaacatgtcgttgatctctccttcacaatgtgaaattgattaaataataaattaatttatcgttagtatattttcatatctagctattattatagcagactttaaacaagtagtgtaccaatttgccattggtttagcaagtatcgaactttaattcttataaatttgctaaccatttcagaattgtttttgccgcatatccgggtatggtaaaatatgattaaattagtaaggttatcaatattagggggaatttactgatgatactcatcgaaagaatttatcgtcgtggtcatgaacagttgacaacggtcgaccaaatcgaaaaatttcaaaccaatgacggttatgtcacatccaacgaagtcctcgcccgcgaaatcggtgcggatagtgaaaactgcttctacaaaaatcaagagggcaaacgcaaaaaagtcgttgcgaccaaggacgatcagggcacttggcatttaaagaccatcggcacaactgacccgactagcgatggcttattgcaactaccgcatatggatgatgtttggggttaattggtgcttcgtttagaagaactgataattagtgttcgtcagttagaactaccatcaaagactcaggtttctgatggtagtttttttatatacatatcgtacggtatacaagcaacgtaattaatagcaattagtatttttattgaattctaatctatcaatgatacttgcattgatataatctaataagcatgctcttttttattgttggcacagcctgacttcaatgtctttggagccaacactcataacaagctagaagtcattaaaagtcaacttgaaaagcaccttatttggaggagtcttatatgaaaaaagtagtcactggggctgccattgttgcgtcattatttatattaagcggttgtggtaatagttcaaaaacatctactcaatcaagctcacatcacaaagaaactgcgaccaatgtcaaaaaggaaaaaactattacggttaatcattcgagcattgtcacttctgacaatagcaagttctcagttcaaggaagaacggaagaaaatatcggtgtttatcttctcaataagagtggtcaagttaaggatacggttacaagtgattctaaaggcctatttcattttaatgaagacaacgatgatgcaaagactgtcccatattaccttacaatcgatgatattgacgcagatactgatcctatttccaacgaacctaataaaaataacgttaacaagcttaaggtttataaaaaaataattgttaaaccttcttctgaggccgttaattcttataaatcttcatctagttcggctatggattctatggttgctgccaattcttcatttgacgaatcggtatccaaaaataattctagtgatagttcgtcgtctgctgctaaatctactactcgtagtatccattatgataaagttgacttagaaacatttgcaactgaaactgataaatacatcggtaaaaacgtcgaaactagtggagaagttgcctacattcaaaagaatccagataatacagatatctattatgttgttatcctccctaaagatgaccatgcatcttcaggctactcatacgggactgttacagagatcaatgtggatacctttgatgaaactaacattaatgaaggcgataatattactgtaaaaggtggcgcactcacatctaccataaaattaaatggtaagaccttaaaatctgatattgttgttgattcagtatctgtaaattagaaaattggcccccaacacgggcttttatttaaaagtaaaaaagaacatacgtttggacattaggaggatattatcatgattattcaaaaaattaccggaaaagaacaaaaacaattggagctgcaggacaagttttatcccggaccaggacgctcaaaaactaccggctacatcgtcgatgataaatggtccgtgtacatcacctacgtaccatttacaggctatcacgtttctattggggatcatcgctatggacttgtccgacccaactatatcaccgttgacgctattgcacggttgggcctattcccctatcgcaagaactacatgctttattctgctggtagtgaagttgttcattttgacattaaagactgaaaggaagtataaaaatgcgaggatcaattagaagacgtggcaaccgctggtattatgcatatgaaggccccaccatagacggtaaacggcagcgaatcgagcacgttggtggtcggacccgtgaagaagcagaacgggccctgcgcaaagcaattgatgagtttgagcgcggcggtgttgtcatcaagttgacagagatgagtgtagcagactacttcgattattggcacgagaattttgttgtaaagactcttaaatataacacgcaaacgaattatcgtaatattatcaacaattacattaagcccgatatcggcatgtaccgaatgaaatcaattggtccagcatcaattcaaaagttcgtaaatgacctacccacagacaagctctcaaagcacactattgagatcattgtttcagtcttacgtaagggctttaagatggccgtcttcccttaccaattaatcaaagaaaatccagcaaactacattgtaaagcccactaataataatgatgatgaaataacccagcaagctgctcgagataagctcaaaatcatcaatatgggccagttcaagcagatactagcacttgttcctgaatctaaccccttgtatctcccacttattatcagcttcaacactggcttgcgccgtggtgaggtttcaggactcacatgggacaacatcgattttgataacaaaaccttgaccgtgaacaagcaaatgattatgaagaaaaaagaatttgacgttacgtcacccaaaactaaggcaagctatcgtacaattgcagtcggaaattcactgctaactgttttaaagcgtttcagaacttaccagaaggaaaataaagtgcgttacggacaattttactttgatagcccatttgtttgtaccaaacaaaatggtaagccgattacccctagcgtaattaaatactacacaactaaactatcacaggaattagactttccatttaattttcactcattacggcacacacacgcaacgatgctgctagaaaatggagccaagtacaaagaaatacagcaacgccttggtcactcacgtatttcaacaacgctagatatctattcccacgtaaccaataagatgaaacgtgatactgttgatatcttcgaaaatatgttaaaaaacaacagttaaaaagatgatagacactttttcgatatatgtatattttgccaacatcacagtttcaatgttggcaaaatgttggcaaaacggaaaaataaaagagctccgcttacgcggaaccctatcagttcggcttttcgtcttcgtcggttttcagaacagccatgaacgcttcttgcgggatttcgactttaccgacagccttcatacgcttcttaccagctttttgcttttcaagtagcttcatccgccgcgtccggtcaccaccgtacagatgggccgtcacgtccttacggtaagctttaatattcgtccgagcaatgactttagaaccaatcgttgcctgtaccggaatttcaaagttttgccgggggataatcgtcttgagcttggcggcaatctcgcgtccacgcgcaggtgcaaagtcgcgatgtgcgataaaactcagagcatcaacttggtcaccgtttaataagatatcgatcttaacgaggtcactggcacggtagccgtctaaatcataatctaacgaggcatagccgcgcgtgttcgactttaatttatcaaagaagtcaaaaatgatttcggacaacggaatgtgataaaccacgttgacccgattactatccaagtactccatcgtatcaaactcgccccgtttacgctgggctaattccatgaccgcaccaacgtaatcattaggcaccataatctgagctttcacatacggttcacgaatttccttgattgcagacgcctcaggcatttcagccgggttttccacctttttctccgtgccatcagtcatccgcacatgatacgttacggacggcgccgtggtaattagttcaagattaaattcccgttcgaggcgctcctgaatgacgtccatgtgtagcagtcccaggaatccacaccggaacccaaagcccagtgcttgtgatgattccgcttcaaattccaatgcggcatcgttcaattttaatttttccaacgcttcccgtaaatcggtgaatttggcattatcagtcggataaatcccagcgtagaccatcggattcatttcacggtaacccgccaatggtttttcggccggatttttcgcgttcgtgaccgtatcacctactcgggtatcctgaatatccttgatgctagccgtaatgtaaccaacatcccccgccatcaaataatcccgtgctaacggtttcggtgaattaacgccgacttccgtcacttcatattcactaccactgttcatcaaccggatccgatctcctggacgaacgatgccttcgtgaatccgaacactcagcaccacgccccgataatcgtcatagacggaatcaaacactagggccttgagtggcgcatcaagatccccctgaggagccggaatcttatgcacgatttgctcgagcagatcttcgataccaataccggctttcgctgaagccagaacagcatcttccgcatcaatcccaatgtcatcttcaatttctttgcgcaccttttcaggttcagccgatggcaagtcaatcttgttgatcaccgggacaatttccaagtcatcatcaatggctaaatacacgtttgctagcgtctgggcttcgaccccttgcgccgcatccacgactaaaacagccccttcacaggctgcgaggctccgtgagacttcatacgtgaagtcaacatgtccaggtgtatcgatcaagtggaagatataagtctccccatcctttgcttgatagtgtaactctaccgcattcaatttgatcgtaatcccacgttcacgttccaagtccattgagtccaacacttggtcttgcatctcacgtttggaaatcgtatcagttagttccagaatacgatccgccaacgttgatttgccgtgatcaatatgggcgacgattgaaaaattccgaatatgttgttgtcggtcttgcattgtcgctttatccattgattttcctactttcttcctaaatcctaatccctacaattataccaagttagtggcacaagcacaatttttctatcagaccgctccagacaccccgctgcgccactgaataaatgacgtaacaaaaaagtacaagccaatatggcctgtactttttagtaggttattcaaaatccttgatttcactgggtttgagtaattgccattcttttgaatagaagtcgtcattaatctgataatgaaccggcttcgtcttcttagtcaagaatggatcaaccttttgatccacggctaaccaaccacgccagccaagatgaatcgtatcagtcatgaagtagtccttaccaccgtcctgggtcaggtccaagacgttattaaacccttgactcttcaactggtactgaatcttcttgtcaaactgagcaatcatcttcattgacagtccggtataagcagaccagcgctgattgattggtggaatgatgaacaagacatcggtgtgtgtctttgcaaactgattcaaaaccagttgaaaatcggcaaattctggtgacttcgtgtaattcaagtgtcgctgtgaatctttgagtcgcttgtaattacgttttaacttcgtgttccaaaattgattgctgatttcaagactgttcgagtccgtttgcgccgcaccgattttaccggctaattggtttaactgattaaagttatatgtcgctggtaacttgttagcttgcgcattgacagtccgtaaatttttgcccgcaattccaaaacgtgagaagaactcatcctcactgccaaggacacgtgccttatagttaatatacgtcatttgtgcgctcgttggtttaaacccagctgccacacgtgccagggcgccttccaaaatgcgatcagaagaacccgatggcatctgtaacaaacgttgagcggcataccggtccattgccgtattctgctcatcctgtaaccaatcaatggtctgcagtggtgagtaatagtacgaaaacgcatctttccgcgttccttgtggcacaaaccattgtggcgaaattacaaagacggccttcttatttgtaatctgctttttcaccgattgcatcgcgaaatactgcgtcaacgactgggtcccccgcgcaccgagtagaaatggtcggtaattgcggtgatattttgttgccagtacggacggatgcattggatcaaatcgtgaccattctgaagaaccaaagaacgggacatagccatcatccagcgcctgtcgtttaactaaccgaccttttaatacgttggctgacaaggaaacggccgcttttttctcagtatccttagaaatatggtttaatccaaatgagaacggtgaaagcagtacggccaataataagacggctgccaaaataattggcccaaaaatcttaaaaaggcgtttggcaacgttcattgcaaggtctcaacctttgcaacaatcttagccggtgtatcccattctgaccgttgaaattcagagaccggcacttcgattcctaattgattttgaagttccaataaaagttggacggaacccattgaatctaagattccttcatcaaacaggttaacgtccatgttactggaaacatcttcccccgttaagtctgctaaaattgataaaaccgttgcttttgtatcatccattgtcattacgctcccttattgtaattatattatggccgggctccaaagaataacgtgttcaagaatcctgagaagatcaagaaactgaaacaaacgacgttaaacgttaggaaaatcgcaaagtattccgtaaatttattagacggcaactgcgcttgatgtttcttcttgtaccgtaaccaagcatcgttgacaaccattgctaaaccatggaatagcccataaacgatgtaataccatgtttccccgtgccaaaaccccatgatcaacatattaataacgtatgccacgttggccgttgtgatccggctcttaaagaccttgtgtttcatcataaagaataccaaccgcatgtagatgaaatcacggaaccagaaggacaacgtcatgtgccaacgattccagaagtctttgatgttctttgacttaaacggttgattgaagttcatcggagtttcaacacccatcaggtaactgataccgacggcaaacaaactgtaacccgcaaaatcaaagaataaatccatactatagacgtacatcacaccgactaacgcccatgacatgccgtgagcttgcaaggccgcgtgttcaacgacaggtagcatccgcgtaccaaagatataagccaaaatgaacttatataagaatcccaagaaaatgtagcggacccccttttcaactaacccgagatacttttcacgggtcgggacactatcgtaatccttaacgaaccgccgataccggtcaatcggcccagacgagatcgttgggaaaaacagcaagaactggccaaacagtaccggatggaattctttaatcaccccatcacgggtctccatgatcatctggaccactttgaaagtcaggtaggaaattcctaagaaaccaataattgaattagcaccatgtgccacggctggtgtgatcttaacgacagctagtggaataatcgctaaaatcacactgacaacgaaaacccagcccttattaggtgaatctggtcgttgtcgatactttgagtacaaccaaactagtgtgatctgatagaccaaatagataattaacgcgatcccagtgcgccacttaacaccgccaaaggtcagcattaagaagataaacgatatcaatgattcataccaatgggatcgccgaccatataacagaccaatcattaacggtaacaacgcgataaagagcagcacaaagtacgttgggttaccatatgggtcaaaagaaatcattctgggttaacctctttaatgatcgacttgacatcaatcttaccgttaggcgttaatggcaagctcgtttgatagacgaaccgttgtggaatcatgtattccatcatcattccttgcaggtcctttttaattgcagtggtcaaagcaaagtcactttcgaagtcattcggctttggtaccacgtacgcaatcatttgcgttactttgtgctctttatcgtattttggaacggcaacggcttgtttaatatgctgttgctgtgctaagaagtgatccacttcttctagttcgatgcggtaaccatgcattttaatttgaaaatcaacgcggccacgataacggaacagaccgtccgcatccatcgtgccaatatcaccagaatgataggcgggttgcccgtctaattcaaagaaagccttggcagttttttcagagttgttcaaataccccttcgaaacggatggtccggcgataatcagttcaccttccgtgccatttggaaccgcctcaccattttcatcaaccacaagtatccgcgtatcagctttggcataaccaattggtagccgatcatactgcgctaatgcggcatccgtaatttcaatttgagttaccgcgacgcaggtttcagttggcccgtacgtattgaagatccgggcatctgggaaccgtttcttgagtgtcgccgccgtcttatgtgtgagttcctcaccacagaacaagaagtgcgtcaaagttggcaagttttcagcattaaactttggttctagcaaacaaatgtccataaatgatggtgttgagacccaaacgttgattggtaacgtcggcaacgcagcaaataattgtttgaaatcatctgtcacggccttcggtaatgcgtatagtgtcccacctaacgctaaggttgggtaaacgtccatcacggataggtcaaatgaatatggtggttgcgacagcgagttcggctggtcaggcaatccgaagtcatcactcaacatccagtcaacgtaactgaccaagttatcatgactaatttggaccccctttggcatcccagtggtaccagaagtaaagataatatagtaattatcatcgccactaacgacatgatccgcttgataatcaacgggagtcgcaaagatagccgccaattgatctggtgtaatcacgggggttgtcccgacaccggttggcaaatcagcaacagcaataacggcagctggcttagcaatctcattaatcattgttaaccgctcatttggtgaatgtgtatcgattggaatatacgcccgacctgacttaacaactcctaagaaagtcgcaatcatttcaaacgtctgaccaccaaacacaataattggatccttggctggtaaatcgagcgtgtcaagatgcgccgccaaggcatctgaataagcttttaattccgcataagtgtgcgttacaccttgcacatcataaaccacgttattgggttgcgtccgtgcataatcatcaatcgttgtaatgatgttcttaatcataattaaaactcccccaaacaatagtgttactgcatccatttttaaaattcgttgtaaataaacttcgcttggttgatcccactataaccgtaaagataaaccaaggcgagcatgacagcaaagtaaaatactgtaagtgcaatgaattgaacgaccggacgttgaaaccagcttttcaactttgcaaacatgccatcacctcctccactaacccaatgtcagttacttaatatcacccttcattaattccgtaaaaatcttgttggctgttgcttgaataccagcagctttgcgatagtagttactcattaatacaacaccagtcttcccatccggtgagaggaagatgctggattcatagccataaccaagtccgtgtgaccgaataccattactcatgttataaacaccaccgccatattcacctgtggctgtgcgcgtgtgcaaaattgcaacgttcttttttgacagcaactgccctttaagaatggcactttcaacggtaaataaatccgcagtactcatataaacttgcccagtacctaactcattggccatttgtgctttgctttctggcattgtttgatcataattcggaagtgtttggtctgcaagcgctcggtaaccagttgtcgcatcttgaccttgaccatgaatcaaaaagcccgtttcattcagattcaacttgtcaataaaatgtgttgtaaagaagtgctgatatgattgaccagttaccttgcgaataatgccagctagcaacagaaaattaacggatgaataattataaattccatttttatctgggtagtaaaaaacattgtgagccgcaaaatcaatcacttgattttctggtaagaattcttttgaaccgctcttcaaacggaaccctgttgtcatatctaacatttggcgaagcgttgtctgacgcccatgctttaaagttggataatacttcgaaatcggatcagtcagcttaactttccccgcctgcaccaactgcataatgccaaccgccgtcattgacttttgaatcgataaaatttgatactttgaattgactttattacgttgatttttagccttgtttgcgtaaccaaaggcacgattataaatgacatggtcatccttaacaactaatgctgaccccacaaaatggcttaggtttaaagccttagtcacttgctcatccgtgttcttattattcgaaaacgttgtctggttaatcttacgactaagctggctattttttaatgccgctttcttattcaatgctttgtcagtttgacgctttttagcaatcgctgcttgccgctctgtatgataaacatagtagccgccaccagcacccacaatcagcagtccaagcaaaactgttactaaaagtttgctttgcttcacaatgattgacctccccattagctatcaattacgaaccgattggtgatattagctacgccgccaataggacgtaagttcaagttatagtgtaacaacctaccgaccaataacggttaggccggctcaaaaagatcaaaatcctgcattttcgttcgctgatacgacatatttgtaacggttttgtaacatcaacgttacgtcccccataagctagcagcgtattacttcacctccttgactaattctagcactcactaatccccggacgacaggataacgaaacagtttgcacaaaaaccgcgttactgaaaggtcacttaataaacaggccggagtgcttgattgacactaaaaaaagctgaacaatcctcatcacatttttgtgatgggcatcgcccagctttttgtatatttctggaattagttcgctcggttaaacaccccgaagcttgtcaaataacgaactcttgccattgccagcaactgatttgccgctagctttagcaaaggtcttcaaagcttctttttgacccttgttcaagtgcgttggcgtttcaatattaacggtaacgcgttcgtcgccgttgccattgccacgtaatcgtggtgcacctttaccacgtaaccggaaagttgtccccgtctgagtaccagctgggatcttcaacttaacgtccccgtgaaccgtcttaacttgaacttcatcaccaagagcggcctgaacgaagtcgatcggcaacttgaagtaaatcgtcgcgccatcccgttcaaagtccttacttggctcaactctgaagataatgaataaatcaccataagggccaccattcgttcccgcttcaccttgattttgaagccgcatttgttggccttcttcaactccagcaggaaccgtcactttgatggaatgactttgttcagtatgaccagagccaccacaagtggcacacttgtccttgatttctttaccagttccatgacaaacgtcacaaacttgttggctcatcattcgaccgagtggcgtattagtctgtacctgaatatagccagcaccatgacatttcgaacaggtcactggtgacgttcctggcttggcaccagaaccaccacaagtctcacactgttcctcacgattgtaggtgatggtcgtcttcttaccaaagatcgcatcttcaaacttcagtgtcatctcatactgtaagtctcggccttgttgcggggccgttgggttagaacgccgtgaaccaccagcgccaccaccgaagaaggaactgaaaatatcttcaaagccgccaccgccgccgaagccaccaaagtcttgaccgccgaaaccgccggcgccaccgaagccttgttggccaccagtcgatccgaattgatcatactgtgcccgcttctgggcatcgcctaacgtttcgtacgcttcattgacagctttaaacttttcttccgcgccaggttcatgattcaaatcaggatgatacttcttcgaaagcttgcggtacgccttcttgatttcgtcctgactggcatccttttcaacacccagaaccttatataagtcttgctctgccattgtaacctcctaatgaaccttaattaagtctcattaatactagcatatttaaagcaaaaaggccaaagccacgtggccttggcctttttgttctgccggtgctacttcttatccttgtctttatccaagtcttcgaaatcaccgtcaaccgtgttgtcatcactgcccttggctgagttggcattgccagcagcattactgtcggcaccgccttgtgcaccctgagcttcttgagcttgttgatacaacttaactgataagtcctgaacgatcttgttcaagtcgtccttcttggccttcatttcgtcaatgttgttatcatcttgagctttcttcaaagcatcacgagcatctttggctttcttaacttcatcttctgaaaccttgccttcaagatctttcaaagtcttgtcggtagtaaagatcaattggtcaacttcgttcttcaaatcaacttcttctttacgtttcttatcggcttcttcgttttccttggcttccttgaccatttgatcaatttcgtcgtcagaaagacccgatgaactcttgatggtaatcttttgttctttattagttcccatatccttagcagatacgttaacgatcccgttcttatcgatgtcaaacttaacttcgatttgaggaacaccacgaggtgcagccggaatatccgttaattggaagcgacctaacgtcttgttatccgctgccattggccgttcaccttggagcacgtgaatgtcaacagctggttggttatcagccgccgtactaaatacttgcgacttgctggttggaatcgtcgtgttacggtcaatcaacttagtgaagaccccacccatggtttcaataccaagtgaaagtggcgtaacatcgagcaaaacaacgtctttaacatcaccagtgatcacaccaccttgaacagcggcccctaaagcaaccgcttcgtcagggttgatagaatggttagattctttgccagtccacttttcaacagcttcttgaacagctggaatccgagttgacccaccattcaagatgacaacgtctaagtcactagccgataaatcagcatccttcaaggcattttcaacaggaatgcgcgtcttttcaactaggtcagcagttaattcattgaacttagcacgtgttaacgtggtttccaagtgcaatgggccactagcaccagcggaaataaatggcaaactaatttgggcttcagaaacacctgaaaggtccttcttagccttctcagcagcatcctttaaccgttgtaaggccatcttgtcttttgataaatcaacaccgttgtcagctttaaagccatcaactaaccagtcgataatcttttggtcaaagtcatcaccaccaaggtgggtatcaccatttgtggatagtacttcgaagaccccgtcgcctaattccaagatggaaacatcaaaagtcccaccaccaaggtcatagactaaaatcttttcatctttgtcggtcttatccaaaccataggctaaagctgccgccgttggttcgttaataatccgttcaatgtttaagccggcaatcttaccagcatccttagttgcttgccgttgggcatcattaaagtaagctggaacagtcacaacggccttttcaaccgtgtcacccaagtaatcttcagcaaagcccttgatatattgcaaaatcattgctgagatttgttgtggggtgtagtccttaccttcgatgctaactttgtaaccagcttcacccatgtgacgcttgattgaagctaccgtattcgggttagtgattgcttgccgcttggcaacttcaccaacttgagtttcgccatctttgaatgccacaactgaaggaaccgtccggccaccttcaggagtggtgataatcttaggttcattaccttcaagaaccgctaccgcagagttagtagtcccgaggtcaatcccgataattttattacttgccataaattaacaaacctctttttaatttagtatttttattgattaattactgtgccacaacaaccattgctggacggagggtccggtctttcaataggtaaccccgttgtaagacttgtaccaccgtatcagctggatgatcatcatcaactggcaccgtttgaacagcttggtgaatattgggatcaaacttttcgcccgcagccgcaacttcggtgaccccatgttttttcaaagcatcctgtaaatggccatagaccatttcgacacccttcttcaactgttgggccgcttcatcgtcagctggcgttgccaaagcccgttccaaattatccagaactggtaagacatcctttgcaagtgcttgaccgtcatattttaacagcgccgcttgttcttttttgttgcggttttgcatgttgacgatctccgcctgtgcacgcaataactggtcatctttcgcatctaattgcgctttgagatcagtaatttgttgtgtcggatcgaccgctgtcgtttgctcagcttgatcatcagtcgcactcgtcgctgcctgcgtcgcttcactggcagttgacgttgctgctgaatcagttgttgacgcttgtgaatcttccgacgtcgtccgcgttgatttctttgccaatgttttcatctccctgtccgtcactcgtcaaagtaccggtaataatctaataatttgcgggctaattctcgttggaacgcacccatcagtccaatcatccgtgaatacggcatggcagtcggcccgagcaaggcaatcacaccttgtccgtgttgatcaacatcgtaagtcgcggtaattaaactgtagttcttcaacaaatcgttggtgatctcattaccgattcggacttgaatccgttgaccgggtggaccaatcacgttagctaaccggtccgtttggtcgagtaacgagtacaatgactgtaactctttagggctctgctggtccgtatagttgaacaaattcaacttaccaccaacataaaagcgctcggaagctgccttggacaacacactgccaaaaatatctaagaaaccatctggatcttgcaaatactgtgcaagttttaacggaatctcatgcgttaattggcggaggacgtcttgtaacggcaggccaaccagttgatcgtcaatgaaacgaacgaccggttccagctcatcgccggtaatgtcactaggaatagtaaacgtctggttttcaacgtcaccattattcgtcactagaatcgccattacttgatgattccccaacggaacgagtctgaaaccactcaaccgactatctttaagttcaggtcgcaatgtaaaggtcgtgtaacttgtcagttgcgacaagatatccgccgactgagcaacgatctcatcgatcttgtgaaattcaccgcctaatgaatgttgaatcaccttcaagtctttgccatccaccttttcaggctttaggatatggtcaacatagtaccgataccccttaatcgatggaattcgccctgaagacaaatgcgttttgacgattaatcctaaatcttctagtcgggccatttcattacgaatcgtcgctgaactgaccttgatcggtagttcttgaactagcgatttggatccaactggattaccgccctcggtatagtcacggacaatggcctttaaaattaggctttgtcgttcagttaacgtgatcatcacctctttttagcacttaacttaatggagtgctaacacaattactaatataacaaccaccctgatgaaagtcaaggaaagacaaagtatttctagaaaagaatgcttaaattattaggacaccagtcccactatgactggacttatttgaccgtcgcccccaattagcactccttacttacgagtgctaatatacaccctcacccttcacaatgcaagcatggtgcctagcagactactcgcttttctgctgccattactcagcacaccagcaacaacaaaaaaatctcaagagttacagactctcgggatttttgactagcctgatatacattgccaacagacattctagtgaaacctggccttaacagtaatcagctttcaaactaatcaacgttcagctttattaatggcatgatcaatggtttcattatcaaattgttcttgtaagtacgcttcattgtcgattggcaagtgcacatgaaagtcagcaaaatgttgaactttcagcgtcgcttgttcgacttcaaaccccagcaagtgtccacctaattgatggtctttacttagaaagtgtaagtgaaagccaccgaccgtagcgccttggaacaaatgcggtgcatagtagccaataatcgttccgtcaacatgttcaccggtgaattccggttgtgttgccgttgccgcgactagtgttttgtacggtggctcctgacgaggcgcgactcgcgtcttgacttttgcaaaggtcccatcgacgcgaatagccgcaaacacgttggtcaaacggtagtcatgaaccacttgttgctcaaaatcagtttgtgtgattgcagctaattgcgcactaatatcaggcttttcaaagtgcaccgatgcaaatggtaacgtctcttcgggctgaatttcacgaatttgaccatcctcacgtgcttgataggcgtgacctcctagaataatcacttcaccattgagaccgtctaacgtcccaatacccgtatcaccatgggttaagagttcaccagccgtaatcgtcccatcaaataagccgggaacaagtaagcctaatgtgccgtgttgaaaaattgttgttgtgtccattcattgtgcctccaaacgatttgattgttgtgcaacttgaatccggggtgtgaccacaaagggatgcgccacataatagtcacgggtgttttgttcatcccgctttaattgcgcaaccaaggcatccgccccagcaaatttaatttcaccgcgcatccggtgcccccaacgcaccgttaaattgtgtccataaagatctccttggaaatctaataagtatatttcaaccgtgattggtcggtgatcaccaaacgtgacatttcgtccaactgaggccattcccatgacccagcgtgtcccaatctgcaccatcgtcgcgtaaatgccaattccgggaacccgggtattgggcccgtgagcaacgttggccgttggaaagccgagcgttcggccccgcgcttcaccatgaactacttcgccggcagtttcatattgatagcccagtaaccggttagccgtatcgatatctcccgcgtccaaagcgcggcgaatccgcgtggaactgatcttttcagcatctaattccgccttaggaacttcaatgatttcaaaccggttatgaccatagtcattcaaacgctgcatatttgcaatttcagctggcccgtacgtgtaatcaaaaccagcaaccaccgtttgtgcgtgtaatccaacaattaactgatcgacaaacgtttggggtggcatggcaccgaccgtggcatcaaagtgaagtacatataagatgtcaacgccgagctcactcatcaatgccgttttttgatcaattgtcgttaaataacggacttgctgcggatcagtgtgtttaaaaacaactgacggatgctggtcaaacgtcatcaccgctagtttggcgtgttgcgcctgagcggtctgacgtgccgttgcaacgacttgctgatgtccacggtgaacgccgtcaaaaaatcctaaggccaatacgattggtccttcgggaatctgactaaacgccacgggatactttaaattaatcacctgcatgacaaaaactccttaattgaccgcaaacattttgaacggcttgtaccgctgttcgtccggtcgataactatatagacattttaggctgttttggtaaactaacgcaaccatcgtgttcgcatctggatcagtttgttgcccttctgccgccgtaataaaggccccattcttgacccgttgccactgctcatccgttaacgtgactcgcgggtactgacttaaagctttatcaattggcgccaataatgctccggccgttccagcatcgacgtgggccgcgatttcctcaaaggtcacggtttcatctaaagtaaagccgccactctttaatcgggtcaaatcactcatcacagcgggtaccccgagcactttgccgacatccaccgctagcgtgcgaacataagtccctttactacaagcgaccgtaaaatagatcgtctgagtctgggttgccgagtcataggtagatgcctgccgttgcttgaagctgctaattgtgacatgccgttctgggcgctcgacagtttcaccactgcgcgcatagtcatataaacgccgcccatttacttttactgctgaaaacatcggtggaatttgcgtaatggcccccgtcatctgtgccagcgcagcatcaacttggtcacttgtgaacggctctgtgaccgcttggcgcgcaatctcctcaccatctaaatcttcagtagtcgttgcaaatccgagggtaatgctcccttggtattctttgccagaagccactaaaaattgcacaactttagtcgcattcccaatacaaatcggtaaaacgccatccacatttgggtccagtgtccctgaatgacctactttgcgggtctgatagagtcgtcggattttagcgacacagtcaaagctcgtcatcccacgaggtttatataatggtagaatcccgttcaacataaaaaacgccttcaatcatttaaattcggtttctagtggcagccaatcgccgtgccacggattcgatcgttcttaatcgacggttttcagtataccacacctcacaaatatgtaagcggattatcacagaattcaaggccctgagcaccgcaactaagataccccaaatcgacacgctggtccggtgccactgacgaccacgtatgtgcctggcaaagccgtatttaactcattgatccagaaaaccgtgagcttaatccctattagtcaaataaaacgactgaaaaacaagaatcgcacaaattagtccccttatcaaaaggataccgcgcgggaccgtccctaattacgccgatgactttcaacatatgctgccatcaaaaaagcgtgcaacggccttagtgtggctgatgtacgcttattcaatgttatcgtcttaaaatgcaaccggcacgctaaccgcagttgacagctacatggttcttcaagcttggagcgcaactggctgctgattcaaccactgctgaatttgacgggcaatctgctggggtgtcagttgatcggttgcgatcgtcaaatcggccgcatcagcatataaggcttggcgccgctgcttcaacgcaatcagtgcccctgtatccaattcattgacaagtggtcggctagtatcatttttaacacggttaatagtggtttgatcactagccgtcaaccagataactggcaccgcgctttgtttcaggctaattgcattcattgcaatggtcggagtaccaccaccggtcgataaaatcccgggtgtttcgagtgcttggagcaaagtctgatgctccaattgccggaagtacccctctccttgctccgcaaaaatagtcgtaatcgaccgtcccgcccgctgaacaatcaaatcatctaaatcagcatgtttagttgctaacccggccgccaaaagccgaccgaccgttgttttcccactacccataaatccaattaaaattgctcgcattcttaattcctccttacaatctgataacccgcatcagctaacaacgacgatgcttgcgttctcgtctttagatcactaaatgtcagttgcaagacaccatcaatctcttcacgaatctctataatatgaatattgactaagctcagctgagcctgtgcgagccgctgagtgacatccgcgagagcgccaacacggtcggggacgttcaaaaacaaatcataaaagtttggtagtcctcccaactgttccggtcccaagtgatcacgcgtcaccttagctgtcgcaaaaaattcgtacaatgttgcttgatcatgcaccctaatggctgtcttgatgcgcaacagttggtcaatataaccctgcaattgattggttattagttcagcattagtcatcaggatggccgcccacatcgtggggtccgaactggcaatccgagtaatacttttaaacccaccagccgctaatcgcaacccgagtgccgaatctgccaaagccacctgagtctgatcaactaaagccgcagcgacaatatgtggcaaatgacttaactgtcctacaatccggtcatgctgtattgcagtgaccgtcaaccatttgacgtgagtcgcttttaacaatgcttgcagccgttgaacggctgcttgattagtccggcccggcactaacaagtaaaaggcgttctcgaataagttggcgcggccagccgtcacacccgatttatgtgaacccgccattggatgaccgccgatgaaagtcacaccgtgctgttgtatggcaagcgcggcatgcatcaccacttgtttagtactcccgacatccgtcacaagcacccctgccttgagtggcatcatagccagtcggtgcaagtcagcaacgatcacatcaactggccccgctaaaataatcacatcagcgtcgctcgcgaccgcggccaaatcagtgccactagcatcgatcataccctgttgacgcgcataactcaggctgacatcgtcacgatcaatcccaataatgtgcaccgtgggatgggcctgcttaatgcttagtgccaacgaactgccaattagccccaaacctttgatcaatacagttgtcatcttcacaccccctggcttaaacgtgctaaatcttcaaagaacgtcgggtatgaaatgttcacagcttcggcggactctagttcggcgggagcggctaatcgcaacgctgcaatcgccaccatcataccgattcggtgatcgccatggcttgctaatggctcggtcggctgccgccaagacttgtgaccatcaatcacgaagccatccggttgcgaagtgatctgaacaccaagttttcgaagctcggtcacaatcgttgcaatgcgatcggtttccttgactcgtaattcagcagccccactgattgtgctaataccattcgcagtcgcagccaacaatgcaactagtggcagttcatcgattacggcaggaatttcagtagcagtgacttggaccgggtgcagttgtgcaaaccgcacgtcaagcgtgccaactggttcgcccatccggtgttcatgatcgaccgtcacttgaccacccatccgtcgtaaaatgtttaagaaacccgttcgtgtcggattcagtcccacgttcgttaaccggacatgtgaatttggaataatcgtcgcggctgtcacgaaaaacgcagccgaggaaaaatcgctaggaatcgttagtgactgaccaaccaaggctggctgcggttggaccgtgattgttcgttgatcaggcgccgtttcaatttgaccaccaaattgttgcaacaaccgttcagtgtggtcacgagtcggtaatttttcaataatcgtacttgcctgatcggcttgcagggctgctaaaatcaaggcgctcttaacttgtgcactagcgacctgcatctcggtacgactaccatgtaaagtccgaccagtgatcgtcatcggtaagtgcccggctgttaattgtacctgcgcccccatggcttgtaatggttgacgcactcgctccatcggccgttgactaagggacgtatcgccgaccaaggtcgtctcaaacggttgaccggctaacaacccagttaataagcgagtggccgtccccgcattccccatgtctaatggttgttgtggttgggtcaacccacgtaagccgcggccactgatcgtaacggtcgtatcgacacgcttgattggcacccctaacttttgcagcgccgttaaagtcgataagcaatcggcggctggcaaaaagtggtgcaaggtcgtcgtcccttgactaattgcccctaaaatcaagcctcgatgtgagacacttttatcgcctggtacacttaagtcaccttgtaacccactagctggttgaatacttagtttttttatcattaatcatcatcacctaatttatttgatagacgcaccacaccatcgaaggtgtcaaacgtgcaagttcacgttcatgagtcgtcagtgtcacgtttttctcattagttagcacgtaggccgcctgattacgttgataagcctgatacgctaaatacttactggcgactgtttgcaccacgacctgatgcacgaccctcgtcaacaattgggcggtcgctgcatgcgtgtaaccaatttgattatcggcatttactcgttggagcacgacgagtggatcgagctgggtcataaaacaactggtcaacgttaattgggacaataatgcgtaatgtatatccccccaactggcattcagtgtgtctgatttgaaagcagctggtatcaccagttggtcaccagaataggccgttaaatcagttaaaatggcttcaaagctcgggtgttcgacaatcaccgcttggtcctgccagttgcgatgattataaacttgcgcggccgcgtaactatccgtggcggtcgggcctaaagtatgaatctgcataggccctcctaatattgccggagttcttcgcggtatgccgtcactgtttgctggaggcgagctaagttactcccgtcaaacgttgccgtcaatgctcgcgttaattcaatcgctaccacactttcaaccacaatcgaggcggggacgatggccgtcgtatctgaacgctctacgcttgccttttggctgactttggtcgcgatatccacactttgtaatggtttgtaaagtgttggaatcggcttcatggcggccttaacaacaatcggcattccgttagtcatgccaccttcaaagccgcccaaatgattggtcagccgtgaccagccggcgtgttcatcccaactaatctcatccattacttggctaccataatggctggcagccgcaaatccatcaccaatttcaacacctttcatggcattgactcccatcactgctgcggctaactgtccatctaatttggtatcccagttcgtgtaactgcccaaaccagccggcacattttcggcaacgacccggataacaccacccaaggtatccccagctttcttcgttgctgtgatcagctcatggatttcgggaaccaaggccgcatctggtaatcgcaaatcattttgcgcgatttgggcttgtaattgatcaacggatagtgttaaatcggccgtcacttgcttagggccaatttgttgaacgtagccaactaggtgaatatctagctgcgccaataattgcttacaaatctgaccgatagccactcgcatggctgtctcacgagctgaggaacgttctagcacgtttcgtagatcgcgatgaccatacttcattccgcctactaagtcagcatgccccggacgtggacgagtgacttgccgcaacgtattggttgccgtagctggacttaccggatccatgattgctgcccagtgcgcgtgatcgcgattcataatcgttaatgcaatcggggaacctagcgtaacaccgtgccgcacgccaccagtgatttggacggtgtcatgttcgatctgctggcgattgccgcggccaaacccaccttgccgggctgcgaggcctgtattaatggcatcaatgtctagctgtaagccagccggaataccggtcagcacccctgtcaattgaggcccgtgcgattcgcctgccgtaacgtaattaatcatgatcaatatcctccttgtgtaaattcgtgtgtaaatccgtctgatatgcgcgtgagttatgcataattgcttgataaatagcttgtaaataagggatatgcgcggtctgggtactcttcaccgcaacttgttgtaacacccgttgttcacgttgctggtctaataccggaagttgctgttgttgcttcaactccccgatggctgtaaccgtctcaaaacgttgattgagtaatcggacgatttgctggtcaatatgattgatacgttggcgttcttgactaagtgtggttgggacatgtagcgcccatacagctaggccgacaaaggcgagaccactgacagcaacaactaaatcaaagcgcatcgcggtcgcaatattttgctttgacaaccacccagtcacgagcggaatcgtgaaggaagcaatactgccaaacgtgaaataaattcctgtgattcggcccttcatgtggggatagagtttgataaataaattgaggccgacctgcatcacgccacccgcagcagtaaacccaaacccgaaagccgccagcatggacagcccagccgctggactataacagataaccgctaacgccaacagtgagccgccattcattgccaacaacaatttggtttctgccaccccacgacgtaacaaccagaaaatcacaataacgccggtgattgacccaatgctgtaaagtgaaagcaaccagtgcgctaacactgacgaaaaatgcaacgtcgtagtggcaaacaagctgacccactgcgtgtagaggatcataagtgccatcgaagtatacccataaccagctaaaccaactgtcgccaaccagcgccggttcttaagtggttgctgggatacgcccgttccggcttgagtagcttgattttttagtggaaactgctgccggttcaacaggatactgttgaccactaggattgccgcggccaggataaatgaccagccataccagattctttgtgcttcaaagttggcaacgagcagtggtaataagaattcaccggcagacatgaaggcctttaataagacattggctgaaccttgccgcccacccatttcaataaacgtcgtgtaggttcccgcatccaacgcggagttcgcaataccggccaaaatcgccaaaccgtatgccagctgaatattagtgaccaatgccatccccacaaagaacgtgaagtagcaagccatgccaagattgacgaagactttacggccaaaacgatctgataaatttcccagaataaagtaggccagtaagcgcccaatgccaatcccagaaatgacataggaaaccgtcgctaacggggtctgccagtgttgacctaacgcttgcatattttgcgttaaaataattaagccaataccatgaataaagtagtttaagtaaagactgattgataattggtgctgacgcatgaataacaactccttcgtggaaataaaaaaagccggctagattgtgaaaatctagccggctcatcaaaatttaatcctaattgatgatattattccagctagactcacggtgtctagctggccaagatgaattgacttcgcttagacacgaacgtaggtgccgtccgtatctaaggttccaacacgggcgctacctaaaataagcaaagccataataataagttgcgttgaatgctaacgtcgtcataatcatctatcctttccgtttcattgattgtttatattaaaacattctcattttgattcgtcaaccctaatttcattttaattttgcaattaagaaatcattttcgcttgtaaaagcgccacgatgctaattcgcctcatcctactactatttacaaaaatcgtcttcagtacgactactcattaaaccaattgtttgcgacggtcgcgagcaggctaccttgattagtcagtctaccgacaacgttcaagcagtgtgtgaatgactagtgtgaccctacaatcagcaccatctaaaccgctgaatctcagtgattgacagcgaacggctccattcaatttgaacacaaaaatagtcgctgtcaatccatctggattcacaacgactatttttccagcgcctaatcttgacgctttaagttattaattaattcatcaatccggctaccgtattgaaccgagttgtcgcgttcaaaagttaattccggggttttatagatgctaagtcgtgagcctaattcactacgaattaatcccgtcgccttagtcaatccagccgccgtcttttcaccatcggatgccttatctgacaaaatactgtagtagatggtcgcttgttgaaggtcgccagttaccgttacaccggtaatggttacacccgcaacccgtggatcacgaacccgttttaacaaaatatcattaacttcgcgttcgatttcctgttccaaacgaccaactcgataatgttgtgccatctgctaatcccccttttaaaggttattcaactggaacttccttcatcacgtaagcttcaatgacatcgttgactttaatatcgttgtaatcttcgattcgaagcccaagttcaaagccttgtttaacttccttaacgtcgtccttgaaacgccgtaagctagctaacttgccatcataaataacgacaccatcacgaatgacccgcacaccagaatcccggtggatgacaccatcagtgaccatcccaccaccaatcgtaccgatcttagaaaccttatagatttcacggatttcggcttgaccagtgatttcttctttataagttggttcgagcattcccttcatcgcgctctcgatttcatcgattgcgttgtagataacttgatgcaagcgaatatcaacatcgtcagtatcggcttgggctttggcttgtggtgttggccgcacattgaacccgataataatcgcgttacttgcttccgccaaggccacgtcactttcgttgatcgccccaaccgctgtatggatgatattgacccgcacaccttcaacgtcgattttacgtaaactaccagctaaagcttcaacagaaccttgaacatcagccttaataatcacgtcaacttccttaagttcaccttgtttcattgaatcaaacaagttatccaaggtgacgtgagcagtttgcttccgttcttccatcaatgcctgcttagcacgttgttcaccagcatcacgggccgtcttttcatcatcaaagaccacgaagcgatcaccagcatccggcacatcattcaaaccagtgatttcaattggcgtcgatggcacggcttccttaatccgcttaccatggtcattggtcattgtccggacttttccgtaagtattccccacaacaattggatcaccaacatgcatggtcccttgttgaacaagtaacgttgcggtagaaccttttccacggtcaagactagcttccaatacagatcccgcagcattttgcttagggttggccgttaattcgagcacttctgactgaagtaagatcatatccaacaattcatctaggttcttaccgaacttcgctgaaatctgaacaaagatcgtatcgccaccccaatcttcaggaatcagaccatattcagtcaattgttccatcacgtggttagggttggcacccggcttatcaatcttgttaacggcaacgatgattggtactttagcagccttagcatggttgatggcttcgattgtttgtggcatgaccccatcatcagcagcaacaactaacacggtgatgtcggtgatgtcagcaccacgcgcccgcatttcagtaaaggccgcatgtcctggcgtatccaggaatgtaataaccttaccatcatgcttaacttggtaagccccaatagcctgagtgatcccaccggcttcgccctctgtaacgtgagtatgccgcaattggtccaatagggtcgtcttcccatggtcaacgtgtcccatgaccgtaacaaccggtgcccgtggcgccaaattgtcggtattattaacttcatcatcaaagaacttgtccaaatcggtcacatcaacttggaccttttcttgcgcattgatcccgtaatcagtggctaagatttcaatcgtatctttatccaaggactgattttggttaactgcaacacctaacatgaataacttcttgataatttcagcaggttcacggtgcaataatttacccaaatcctgggcattcatgccgaccgtgtaaaccagtgtttctggcaacggcttgtccttacgaactggcgctggcttattattgacctggcggatccgttgattcttattgttccggctcttattgttccggttgttacgccgacggttattgttgttaccgccacgataacgaccaccaccgttattgttgctattcaaactaccaccaaagcggccgctgccattacgcgaactattattcgacccattgctccggttactgttgttattattgttgttcgtcgtagtccggttgttgttccggttctgaccaccattattgcttcgattaccagtattgttggtgcggttgttactcgtatttgagcgattgttattattagaccggttattattattattgttgttagaccggttcgtattgctcccaccgttattacgagcactgttgctccgtgaagcattggccgaacgattgccgttattactgttagtacggttaccgccgttattgcttcgattaccgttactattacgactttgactattattttggttattattacgattattattcaaagaatcaccactctgttgatgacgcgagttggattgctgctgattagcagttcgtgtcacattttttgctacggcttgcgtagcccgactcgttttagctggggccggttgagatttaggatgggtaactgtggtcgtgccttgtaactggcgcgcctcactgtcaccgagtgtcgacatatgatttttgacggagaatcccaactgctgtgcttgcgcaatcagctgtttacttgggacgttgagctccttcgctaactcataaattcgctttttccccatatcttcaccctcctttactgtgtcatgatcgccaccattttcttggcaaatccggcatcggtaattgcataaacagtgcgcttattaccagtagccgtatttaattctgctttagtaaaggtatcgatcactggaacatcataagattgggccttatcatgaaactttttggcagtcgtgggaccggcatcgctggcaataaagaccagtttagccgtctgattacgaattgcagccagggctagcccttcgcctgcaatttgcttgctggcacgccgtgaaaggcccagtaggtttaaacaagcttgcttaggcgtcatttccgaagagttcctttcgggcttgttgatgatcaacataagccactaactcatcgtaaaagtctgcacccactttgataccaaacgccttatcaaaagtcttttcttgcttggcacgttgtgcaacttgtacgtctaaggcaatgtaggcgccgcgtcccggctttttaccagtcggatcaacggacacttcatcctgcttattcttaacgacccggactaagtcttttttgggatgcatttcacccgtcacaatgtcctttcgtaacggcacttttctttttttcataatcccagacctcctttagttacttcactcacttagtgacgaacttattcagcgtcacttgctgattcatccacagtagtttctgaggcaggcgtcgccacggctgcgtcggacgttgctggttcctcatcttcgccggtatcggactgcactgccgcgtctgatgctgcttcagtcgtttccgtttcggcaactgcaacatcatcagggtttgcatccattatatcagaagcttcggtttccgatttaatatcgatcttgaacccggtcaatttagcagctaaacgagcattttgaccacgcttaccgattgccaatgataattgataatctggaacgaccacggtacaaccccgctcattttcaggatcaaaaataacatccaaaacttccgctgggttcaatgcattcgcgataaatacggcttgatcatccgtccattccacgatgtccatattttcgccgtgtaattcattgacaatcgtttgaacccgttgtcccttgggaccgacgcaggtaccgactggatcaacgttaggattgtttgaacgaacagcaactttcgcccgatcaccggcttcacgtgcaatcgaaacgatttcaacgatgccatcgaaaatttcaggaacttcttgttcaaacaaacgtttcaacaaatctggtgcagtccgcgaaacgaatacttgggggcccttcgttgcgttttcaacttttgagacgtaaaccttaattttgtcatgaatccgataaacttcaccaggtaactgatcagaacgacccatgaccgcttctactttacccaaactaacgtagacaaaccggttatcttggcgctcaacttcaccagtgacgatttcattttcatactggctgtattcgtcataaataatgccacgttctgcttcacgaactcgttgcatgatgacctgcttagccgtctgcgctgcaattcgaccgaagttcttcggggttacttcaaatcgaatatcatcaccgatttcgtaggctcggttgatagccaatgcatcttgcaaactaacttctaaacgtgaatcaaagacgtcttcaaccacttctttaacggcataaacgtgaatattacccttaatttggtcaaagtcaacttcaacgttttgagcctggccgtaattacgcttataggccgaaacgagtgccgcttctaaggcctcgatgacaacttcttttttaatgcccttttctgattcgagggtgtctaaggcccctaataattccttgctcatgtgtagactcctttacttatttagaactttaccgctaagcgggcttgtgagatttgttctcggttgatcgtcaccgtcttgtgacgtgtcttatccaagtaatcgatggtcaaagtggtcggcgtcaccgccgtcaaatcaccttcaaaaactttcttaccatccaacttctggtataagccaacgtgcacgtacttaccaatagcattttgaaaatctgcttccttcttcaatgggcgttccgcaccaggagaagaaacttccaaaaagtaagcttggggaatgggatcaggctccatcgcatctagcttttcactaagttcatcactaaccattgcacattcttcaatattaatgccgcccggtttgtcaatgtataatcgcaaataccagctttgaccctcgcgaacaaattcaagatccacgagttcaaactggtgagcactgacaatggctgcggccactggctgaatggtttcaacaacattactactcaaggctgcgcctcctattcagattagtccaataaaaagagtgagcatcgctgctcactcgttaacgagttttaaattacaacccatatattagcacaattatgttgaaaccgcaagtttacgccatttatagcatttagccgttagctttcaagtcacagtaaacttccgcttcaacagcctgacaattgccggtgtatcaacattacaggccctaaatcagataaatctgtctgagtgctgttaaatgcatcaaccaccgcaaaaattcatcaaactttaacaattgtcgtgttttctagaacaacgagagttggttttcatctggcaaatcacttaacacaccattttcagtcataaagtcgatcaaactcttcgacacttttccacgcttagacaggtcttccttcgacaggaacggcttgtccgctcgggcagcaacgatttgcttggcaacgttcaaccctaaccccggaactgctcggaacggcgcaatcaacgtatcaccatcgatcagccaatccgaagcatcagatttgtcaaggtcgaccatggagaatttaaagccccgctccaacatttcgttggctaactctaaaacggtcagtaagtttttctccttggcgctagcatccatccctttgtcagtgatcgccttcatcgacgctttgacagcatctttaccatgggccatcgcaaccaggtcaaaatcgtcagcacggactgagaaataagccgtgtaataaatcaacgggaagtacactttaaagtaagccacccgcaacgccattaagatataggctgccgcatgggcccgcgggaacatatacttgatctttagacaagattcaatgtaccagtcgggaacgttggcatccttcattgcttgttgccattcatccgggatcccccgacccttccgcacgtgttccataatttggaaagacatatcagattccatgccgtagtgaatcaagtcggtcatgatgttatcacgacaaccaataacttcggccagcgtaaccgtgccatccttgatcaattcttcagcatttcctaaccacacgtcagtcccgtgtgaaagtcctgaaatctgaagtaattcgttaaacgtggatgggtgagtctcttcgagcatcccacggacaaaccgcgtcccaaattctggaattcccagcgtccccgttttcgagaaaatctggtcttctgtgactcctaaaacttcaggactggagaaaatcttcatgacgtgcggatcaactggtggaatactctcaggttggacacccgacaaatcttgtaacatccgaatcatcgtcggatcatcatgtcccagaatatcaattttcaaaatattatcatgaatcgaatggaaatcaaagtgggtcgtttgccaggccgcactctgatcatcagccggatactggacgggcgtgaaatcataaatatccatgtaatccggcacaacgataataccggccggatgttgcccagtcgtccgtttgacgccagtcgttccctttgctaatcggtcaacttccgccgaacgaagtgtttgattcgtatcccgttcatacgccttgacataaccataaccagtcttatcagcgaccgttccaattgtcccggctcggtacacatttttctcaccgaacaagactttggtgtaattatgggcaatgggttggtagtccccagagaagttcaaatcaatatccggcaccttgttcccataaaatcctaagaacgtttcgaagggaatgttttgcccatcacgcaccatgtcagtcccacattcagggcaatccttaggtggtaaatcatagcccgatccatactcgttattcgtataaaagtgcgagtactgacaatttggacaccgataatgcggtggcatcgggttcacttcagtaatcccagacagcgtcgctacgatactcgaaccgactgacccccgagacccaaccaagtaaccatctttattactcttaaatactaggcgttgggcaattaagtaaatgaccgagaacccgttaccgatgatactcttgagttctttatccactcgtttttggacgatttctggcaacggattaccgtaccacgcatgggcacgatccatcgtcagtttttcgatttccgcttcggcacccttcatccgcggagtatacaacttatccttgactggtcgcacgatttcaaattggtcagcaagcgcgcggggcgtgtcaaccacgacctcgtgtgccgtctccgtacctaagaaatcgaaatctttaagcatctcatccgttgagcgaaaatgcacgtctggccgttcagtccgatttaacgggttaccgggctgtgaatgaatcaaaatcttacgataaatcttatcctcaggattcagataatgcacatcccccgtagcagcaaccgggatattcatctcatggcctagttccaccatgttgctgataatttcttccaaatgatccgtatcagcaatcaaaccactctcgatcagcgccgaatatgccggtttcggttgtacttccaggaagtcatagtagccggccttttgtcgggcctcttccttccccttttgcatcattgcagtaaagacttcaccactagaacaagccgaaccgaccaggatgccatcccgatatttgtttaaaacactgcggggtacacggggcacgcggtaatagtactcaacattcgacaaggaaataattcggaagagatttttcaaccccgcttgggtttgcgcatacaatgtcgcatgaaatggccgggcatggcggtaagccgcattttcattcatatgatcattcagctggtcgtggaattgaacctgataacggtcctccgcatctttcaaaaacaggtggttcaaatgaccagtcgtctcagcatcatagatggcacggtgatggtgctccaaattaacgttgaattttttggctagggtgtttaagcggtacccgcgtaaattcggatacagccaccgcgccagcgtcaacgtatcaataattggatttgtaatcggccccatgtgatgccgggcatagcccgtattcataaagccaatatcaaaggtgacgttatgaccgaccacgattgcatcaccataaaattcgcggaaaagtttaaacacttcttcttccgatttagagccccgcaccatatcatcggtgatactcgtcaaattagtggttgtttccgacaagtgaaaaccagggtcaataaattcctcaaactgatcaacgacgttccctttgaccatcttaaccgctgacaattcgatgacccggtcataaatggcggacaaccccgtcgtttcagtatcaaaaataacataggtggactctttcaaatcaacgtgggcgtcattataagcaatcggcaccccgtcatcaaccatgttggcttcgacaccgtataaaattttgatgttatttttttcaccagccgcaaacgcttctgggaacgcctgcgcccccgaatgatccgtaatcgcaatcgccggatggccccatttagcagcttgtttgacataatcactgacactgttggttgcatccatctgactcatattagaatgcaagtgcaattcaacccgcttctcatctgccggcgccgtgtcttgccgactggcatgcgacgtttcgttaatatcatacgcattgatcgttaaatcgcgcataaaactatcttcctgaacggaaccacgtacacgtacccacattccaggtttcagtgccgcgaattgtgcttcgtcatcagcattccgtgagaacttcttgacgaccattgacgaactatagtcggtcacctttagaatcaataactgccgctgggaacgcaacgtccgcacttccatatcgaagacatagccttccacgacgaccgaccgttcttcttcagtaatttggaccatctgcttagccggctcttgcgggttgatctgcttgcctaattggacaggaccatcaattggtgctggtgcatccgcctgcttttgccgtttctcattagcttttttgatagccgcttccgctttttgggccaatgcttgatcagacttcgctttttgttcatgaaattccttgatcttcgcctgtgaagcactctcatcaatcatcgtgtggacggagaacttcgggaagcccaagcgatgataggtactctcaatcggccctaatgcttggttggttagaaaattttgaataacttcattttcagccaacaaaatgacccgaccatcttcataagtcggcacgttgctgttacacaatgattggaccaggggcgacttgatcccactgtgctgaacgatccattcccagtattcagctagttcgcgaccattgacctcggtatcatcagtcacgatcgtaaaggtcacgcgtgcaatttctttaaaggcgatttggagtttgttttgaaaagtcataaattgtgtataaggtaaaacatgttggaaatgcaaatgaaattcccaaaccttggaagcttgatgaacggtcaatttatcgatcgctgcttctgtaaattcaggacccgttggcatttcaatttgttcgagtaacttctcgaacatttcttgttggtttaaactcaccagtggtcctccttttgttgattacaatcagttagtaagacacgcaccgtacttgttaatttgcgcttgcatatatattaaagcaaatccaatcttaaaatcaaaagctgctaaccgtgacccactagaaacagaatcccgtttcaacgatgacttagtcgctaacaactaacccaacgccaagcaagacttttaatattaactagaaccccaattaagtgctcagggccgcggtccacagttggcactactttgtcagtttgcttaaccgagaccgtgatgcctcggcgattaacggcatctgaaataatcttcagtgaacgcacaaatcgttcacttgaaacgttactattttatcacagtctgaccgttgagccacgtgattaatcggcaaacaaaaatcacccagtcaacggaatctaaccaggtgattgttgttggcgactatcaacgggtagttgccatatttttattaacttagttttgcagcattttaatcgatattcttgagcagaacggccaagttgttggcgatttcttcctgtttaacttccaaagtctcaccagtctggcgaagcttgatctcgacgattccttcgctggcctttttcccaatggtaatccgagcaggaatgcccattaagtcggaatcagcaaacttcacaccaggacgttccttccgatcatcatacaaaacgttgtacccagcggcttctaattgtgcttcaacttggtcggcaacctcaacctggtccgctttcttcgggttaaccggaatcacgtgcacatcaaatggtgcaattgcttttggccaaatcaacccattttcatcagcgcgttgttcagcgatggcagacaacaaccgtgagacaccaatcccatagcagcccataattaccggaatattacgtccattggcatccaagacttctgcgtgcaagtctttagaataacgggtgccaagtttgaaaatatgtccaatttcgatacccttggtgaacttcaagacgcccgcaccatctggtgataactcaccttcctgaacaaagcgaatgtcaacgtaagcttccgcgtggaaatcacgttcagggttgacgttcgtgaagtgatgaccgtcttcgttagccccgaccgtaatgttgaccatgtccttcacatactggtcagcgacaattttaacgtcatcatgaacgttaactgggccgagtgaaccaaagctagcgcccaaatattgttgggcttgttctggcgtagccatttccaagaaatccgcaccaaggtaattcttcaacttaacatcgttgacttcatgatcgccacgaaccagtgccattactggctgatcgtctgcaataaacagaatactcttaaccagttggtcagcaccaacttttaagaactcagccagttcgtcgatcgtgcccactccgggagtatcgatcttttccatatcctttaacgaagcatgtgacttctttgggacgtataaactccgagccatttcaagattagccgcataatcactcgcatccgaataaacaattgtatcttcaccaaccggtgcgatggccgaatattcacgggaatcctttccacccatcgccccaccatcaccgatgattgaacgaaacttcaagccgacccgctcaaaaatattctgataagcttgcgccatatcttggaacgtgtcatctaatgaggcctcatccacgtgaaatgaataggcatccttcatgatgaactcacgcccacgaagtaatccataacgtggccgatcttcatcacgatacttagcctggatttgatacaaagtcaatggcaaccgtttatacgatttgatttcatcgcgaacaattgacgtaaatgtttcttcgtgcgtggggccaaggataaattctcggtcatggcggttcttcagcttgaatagttctggaccgtatgtctcataacgcccagttgctttccacaactcagctggaatgactgctggtaccagcatttccgctgcatcaattttttccatttcttgccgaatgattttttcaatattcgtcaatacgcggtaagccaatggcaaataagcgtacattccggctgaaatttgtcggatatagcccgcccgtaacatcatttgatgactcaaggcttcggcatcattaggcacttccttgagtgttgggattaacaatttcgactgtttcatctacaaatcttctccttattgttccaaattaaatatcacttagaagaaatatcgctgaatatcattccaagttactagaatcattaataacatcaggaggccaaaaccaatcaaggtaatgacactttccgtttccacccgtagtggtttaccccgaatgccttcaacaatgtttaataatagtttaccaccatcaagtgctggaatcggtaataaattaacaattccaaggttgatcgacagcacggcgagcaaataaatcaccgtgcgtaccccggacttagcggcttgcgaggtcgtggcaaagattgccaccggcccacctaaatcattcaaactgaacccgtgagtgaccatccgaccaagcacttgaaaaatctgtttggtaattccccacgaaccagtaaagccgtatgctaacttggcccccagactcgtgtcggtcttagtcgcccattggaccccgatttgaccgattcgattaccagagaccgtcttggcagcaggggtaactgcaatttttttagtctgaccggcccggttgatggtcaaagtcaaccgttgcttcgggctgtcttgaatcaacagcgaaatcgattgggcactcgtcatttttttaccgttaaccgccacgatttgatcgcccttttgaataccggccgtacgggcaactgagtctgctgtcgtcgccgctacgtgggtcgttgtactcgtaacaccaccctgcataaaggcaagaattgcaaatgtaatgatggccaaaatgaagttattcatcggtccggcaaaattcgttaacattcgttgccataacttggccgattgaaattggacgtcgaccggtgcaatttgaacttcggtaccatcgctttcaacgatcgtagcgtcatgatcgacggcgtagtgtttaacttcactttcgtccccgttctcataaccttcgatccagagttctttttcgagatcagtcgccgtcactgacagtggaattccattgaacaacgttgtcttcttactagcattgattgaatgaacaatcccatccggaccaatttgcaaactaactggcgttccgggcttgagttcttcatcttcatcatcggccacaccggccatccgtacgtaaccaccgattggcagaaaccgtaacgtataagttgttgcattacgacgaaacgcgaccgccttgggccccatcccgacagaaaattcacgcactagaatcccagcctttttggcaaagtaaaagtgcccaaattcatggacgatgaccaagattccgaaaacgataatgaacgtaataattgtaacgatcaattaagcgctcctttctcccgcgtttcgggtactcagcttaaaagaggccgaataaatgtgcaattggaaaaactaataacatactatcaaatcgatctaggataccgccatgtcccggcaagatcttaccagaatccttaacaccatagtaacgcttcaacgcggattctactaaatcgccaaactggccaactactgataagactaaagtaatcagtaccatactgatgacgctagcatagcccacgtgaaacccaattgcaaaggcactggcaacgatcacaccaatcacgctacccccaatacaaccttcccatgttttattggggctgatcggtgtgactttatgccgacccagtttgcgtccgaccatgtaagccccactatctgtcagccagacaatgaacatcaggaagagtaacatgtaaacactgacaccccgcgcagccgtgaagtagttgaagcccatcccgatgtacaggacgcctaacgtcaacattccggcatcatcaaatgaaaagcgattccgcgaccacacagtgtgtaacagtagcaagataactaagaagtaaaccacgtactccttgtttaattggtctggtaagccattgaaccagttattcggtgcaatttgaatcataactgcaagcatgcttacgattgcttcaaatgaaatcaataattttttacgcatcacgagtaactcgctcatcgcaacggcccctaacagcatggccacaatatctaaggttaccccgcccacaaaaatgactgggataaataaaattaacgcaacgacagccgtaatgactcgttgtctcataccaaaaactcccttttatttatgatccgacaacccaccaaagcgccgatcacggctctgaaaatccgcgatacaggcttgaagggtcgccgctgtgaaatccggccacttcacatcagtaaagaccagttcactgtaggcaatctgccacattaagaaatttgaaatgcgttcttcaccactcgtgcgaatcagcaaatctggatcattgtatggcgcaagtggtgccgtcatcagtgctgcgtcgatggttgcatcatcgatatcaccaaccgccaattgaccatcttgcacttgctgggcaattttttgcaccccggtcacgatttcggcccgtgaaccatagttgagagcaaagttcagcaccatcccatcacaatctttggtatctgcaatcgcattttggactgctttttgcgttgcttctggcaagtgatcaacgtagcccatgacttgcacccgcacattattttttatcaagtccggtacgaaagtatcaaagaaactcacgggcagctgcatgaggtaattaacctcatcagttggccgcttccaattttcggttgaaaacgcgtaaagcgtcaggactttaacgcccaaatcacttgcggcaatcgtaatctttttgaccgtgttcataccttccttatggccagcaacccgtggtaaatgccgtgctttggcccaacgaccattgccatccataataatggcgacatgggctggaatacgttcaggatccaattgcacgtcggtgttatctgcaggatcattcttattaaaaaaagcgaacaaggcgcacctccataaaaatagcttaactatgcactattttaccaaaaaaagcactaattaactattcgtcaacaaaaaaaggcttgaatttctccaagccttaataaattggtcggtcattaaccttccaaaatttctttttctttgtccgcaacgattgcgtcgacgtccttacccgcttgatccgttaacttttgggcttggtcttctaactgatgtaactggtcgtcagtgaattgaccatctttatggcccttcttcaaggcttccattgcatcacgacgcacgtttcgaacggcgaccttggcacgttcaccttccgccttaacgtccttggcaagttctttacgccgttcttccgttaattgtggaataactaaccgaatcgcagaaccgtcgttagctgggctaataccgaggtctgacgctaaaatagctttttcgatttctttaagggcactcttatcaaatggggtcaccattaagacccgtggttcgggtactgtaattgccgccatctgattaagtggtgtttgcgcaccgtaataatctgcagaaatccgattcaataatgatgcgttagcccggccagcccgaatattaccgagctcgcgttgtaaagcggcttccgccttcttcatccgttcctgtgcttcttttaaaattggttctgtaattgccatattatttccccctgactgttgtcccgatgtgttcaccggcgacgactttccgaatgtttccaggttcattcaagttaaagaccacgacaggaatgtcattatccatcgataaggaacttgccgtagtgtccatcacttgtaaccctttgttgataatgtcgagatgggtaagcgtatcaaatttaactgcactagcatccttgttaggatcagccgagtaaacaccatcgacgccatttttggccatcaaaatcgcatccgcgttaatttcagcggcccgtaatgcggcggtcgtatccgttgagaaatatggactcccggtaccaccggcaaaaataacgatccggcgtttttctagatggcgcattgccttccgccgaatgtatggttccgcgatttgtcgcatttcaatggatgtttgaacccgggtcggcacaccaattgattcgagtttatcctggagtgccaaggcattcataatcgtggctaacatgccgatataatcagcttgggcccgttccatacccatctgggcaccagcttcgccacgccacatattgccaccgccaacgacgattgcaatttgtacgcccatgtcatagacgtccttaagttcctctgccaccgttttaatgacggggggattgattccaaagcccttctcaccagctaaggcttccccactcagttttaggattacacgcttatatttaacttccgacatcgttttgtcctcctcgaaattatctgtctatcattttaccatatatttcaataagcgtttggtatcagccgtaatccggcgcaaaaattaaccgaattctctttttaaagcggcttcaacccgttactttacaaaaagggactacgccgaaaattgctttccgtcgtaatccccaattagctaatcccttagtcagtaattagtctttaatttggttcataacttcatcgatgaagttatcagccttcttttcgattccttcgccaacttcaaaacgaatgaatgagctaaccttgccaccctttgattcgacaaagtgcgcaacagtttgatcagaatccttaacgaattcttggtcatccaagctaatttctgaaagccacttgtttaaacggccttcaaccatcttttcaacaatcttttcaggtttaccttcattcaaggcttccttaacaagcacgtctttttcatgagctaaccggtcagcaggaacttgttcacggttaacatattcaggattgatagcagcgacgtgcatggcaacgtccttagcagtagcactgtcagcaccgtctaagacaactaaggctgcaatttggccaccgttgtggatgtatgaaccaaaactttggtcagcacccttttcaacaacttggaaacgacgaagactgatcttttcaccagttacttgcgtcgtttcgatgacgtcatctttaaccgtcccgttagccgtcttcaaagctaaggcgtcgtcaacggaagctggttcttcttcagcgatcttgtcggcaacttcagttaccaagtttttgaacttgtcagttgaagcaactgaatcagtttcacagttgatttcaacaatggcagctttgttgtccttgattgcaacagcagcaatcccttcggcagcaacccggccactcttcttttcggccttagcaacccctttttcacgtaaaacgtcaacggctttttccatgtcgccttcagtttcaactaacgcctttttagcgtccatcataccaacaccggttttatcacgaagttctttaacttgtgctgcagaaatctttgccatagtttactctcctttgagtatcttgattttagataaaaagctgcccgcaaaatcaggccgtaatggtccgcgattttttgggcagcctaattatttcaattaattatttgtcagacttggcgtcgttgtcgccttcaacagcttcaacgatgtcttccaatgagtcaacggacttcttagcgtccttgttgtccttgaaagaatcttcagtaacatcttcgtcttcaccttgacgaccttcaatgacagcatcagccatcttagaagtgatcaaacgaacggcacggattgcgtcatcgtttgaaggaataataacgtcgatgtcatctggatcagtgttcgtatcaaccatcgcaacgatcggaatgttcaacttttgagcttccttaacggcgatttgttccttacgaggatcaacgatgaagattacatctggaatccgaggcatgtcttcgataccgcccaagaacttttcaagcttggcacgttgcttcattaataatgaaacttccttcttaggtaaccgttcgaaggtgccatcagcttccatcttcttcaagtctttaagacgcttgatccgtgtttggatggtgttccagttagtcaaagtcccacctaaccaacgatggttaacgtagtattgacctgcacgggttgcttcttcttcgattgaatcttgggcttgtttcttagtcccaacaaacaagataacaccatcatcagccgcagcattcttaacgaagttgtaagctgagtcgatcatcttgaccgtcttttgtaagtcaatgatgtagatgccgttccgttccgtaaagatgtatggtttcatctttgggttccaacgacgagtttggtgaccgaaatggacaccggcttcaagcaattgtttcatagaaataacagccataataaatgtgcctccaaaaaatttgttttattcctccccaccgttcaactaatcatggcactctcccgagcaccgccatgatcatcgcagtaggtgtgaattggttttaacaccgaaaattagtataccgaaaattactagtgcttgcaagcaatttcatcaagaatttgtgaattcctgaaagtgtgttaaaatacaatctcgcatagggggctcacttaataatgataaaagccatcatttttgaccttgacgatacgttgtatgatcaaaaatcaccgttcactgctgccttaactaaaacttttaaccaggctttgagcagcactgaattggcacaaatttttaaccggttccatgattttaatgaccgtacctttaaccaggtcactgatacaactatgacactggaagcgtggcaaaccgcccgtattcgacacgcgttagcacccagcaaagtccacatcagcactgatcgggctatccaatttgaaatggcctatcagcaggaactaaatcagatttgccttttcgatgggctgagtgcgacgctgactaaactcagtcacgcttttaaaattggtatcattaccaatgggccagcgccgattcagcatcaaaagttacatcaattacaaattgaacatttcgtgcatccggataacatctttatctcagaagaattgggtattgctaaacccgacccatcgattttcacgacgtgggcccatcaggttggcatcaaggccaacgaagccgtttacgttggtgacaatgcagcactcgacatgaccagtgccaaacacgctgggtggcaaactttttggtttaatcaccggcgcaatgaccaggtgacaccgagcgtaattcctgatcaaatcatccagagtccagcggaactaaatgaactattgctagcacttcttcaagccgccagcgcttcatagacgcatactggcgttaaagctacgagcaacttatgctggtaacaaccacggtaagtacgtgctagcaagacctttacctagcaacacttaattgtgttatcgctaacaaaatcgctcacttgtgaagcccacagccgtgcaaccagctcgattgtgggctttttgttatggataataacagcattgaaagtacgcttggggttaacgcttcgaaaaggccccattagatgaaagtataaaaaatggcgtcactcagatgagtgacgccattttcagtgataatcgagattagtcaaacttaacttgtgtgtcagctttaccagtttcgatgaattgtttgttactgttcattgaaacgtgcaccatgttgtgaacggcagtttcagtgtagaaagccgtatgtggtgtaatcaaaacattgtcgcggttgaacaagttcatgaagaccttgtcatcaatcgtttgaccttcaaggtctttgttgaagatcttagtttcgtattcatacgtatcaagagcggcaccggcaactttgccactgtctaaggctttgattaagtcttctgaatcgatgagtgtcccacgagcaaagttcaagatgtaggcgccatctttcatcttgctgaaggcatccgcattcaacatgtggtagttatccttcaatgcaggaacgtgtaacgtgataacatcagcttgggcgtataattcgtccaaggtgtcaacgtacatgccttccttttcaagttcagcattccggtaaacatcgtaaccgataaccttagcgccgaagcctttgaaaatatcgatggcagcacggccaatccgaccagtaccgataacaccaacagtcatggtgtttaattccttggcaatatctggtgcccaacggaagtcttgcttagctaacttcttgttgaacaatggggtttgacgtaataattgcatcaattgcgttactgataattcagcaatcgcatttggtgagtatgcaggtacgttagaaatgtttaagccacgtgctttaacagtaggaacgtccaagttatcaacaccaacgttacgaagagagatgttcttaaccccttcgtcggctaacttgttcaatacttcagcagtatagtccttttgttggtatacatcggcaccgtcgaagcctttagctaagtcaacgttgtcttcagtaagtaattctggaactaatttaacttcaacatctgggttttctttcatccaagtatcgaagaatggacgttcgtcatcacgtacagcatatgcaataattttcattacaaaaattcctcctatatattgatacagtaaatattataacagtaaatgcgagaaatagaatcataaattgtgaaaacttcgctaaatttttacatcgtgagctgacaagtattttagcttggcagctcgcgattggtgtttgaaggcatattcagcctttaacgcacttgatttgtcagtgaaagtttcatggtaaattaattgcaaaggccgccgtgagctgacccgcgtatatttagcccctttgcccgcattgtgcgttgctaatcgtcgctgcaagttatccgtaaaaccaccatacaacgtttgatcagcacataataggacataaaaataatattttttggttgccgtcgtggacgcagccggcttacttgtgcttgccatagagtaatgtgtgcacctcttccctgtattcaccatcatcacgataaacgacaagcggtggcatgattcgaacaccgttgcgtttcccatccttgatcatttcgatcagaactatgttcgcttcccgttgtgctttgggatggacgaaccgaatccgtttgggtgccaaccgattggtcgccatggtactgaacaagtcatctagtcgttcaggacgatgaacaaaatatgctttaccattcatttttaacaaatcactagttaccgctaggatctgatctaaattagcggacagttcatgccgtgcaatcgccaaatgaggatttggatttttaacgctctgcggtcgatctttaaaatacggtgggttacataagactgtatccaccgaatctttcggtagttggcgcgtaattgccagtaagtcttcgttcaggactgtcatttgttgggttaaatcgttcaaaacaacactgcgttgagccatatcggccaaccggggctgaatctcgaccgccgtaatatggccttgagttttagcactggcgaatagacctactgcgccattgccagcacagagatccacgatctggctcttaacgcccttcgcaacctgggcaaagtcacccaacagaacagcatccagtgagaacgcaaagacttgagaactttgaattatttggatatcttgactatataattgatcaatacgctcatcggcgtgtaacgtgacgtctgccatattcggccacctctccattaaaatcatcgcacagttatcatacaattaacttgcagaatttgccaaatttcgtcatactgtgagcagttagtaaacgaaaggaagatcgtgatgttttattcttttatgcgcggactagtccgactaatcatcaccattattaacggtcggccgcactatcaaggacgggaaaacttgcctgagggcgcctacatcttagttggaccgcaccggacgtggtttgatccgttgtactatgcgttggccggcagcccaatgaaatttagctttatggccaaggaagaactatttaagaatcccgtcttgcggttcattctcgtccatgcgaacgcttttcctgtcaatcggcaacatccaggaccttcagcaatcaagacccccgtcaaatttttgcgcagcggtaagctttcattaatcatgtttccatcgggaacgcgccactcacaagaacttaaaggcggtgcaaccgtcatcgcaaaaatggccggtgttccactagtcccaaccgtttaccaaggtccattgaccttcaaacaactttttagtcgtcagcgggtcaccgtccgttttggtaaaccgattgatattgatcgtaagctgaaactagatgatgctggtcaaaaacaaattgaaactaaaatgttgcacgcttttgacgacttggatcgtcaaatcgacccaacgttcaaatacgttgatcctgctacaacccgtcagaaacattaagttcgataataaaaaagtgtcggtgatcgcaatttaaagcgagccgacacttttttactacttgttatcgtttttagatgcagctttcatcgaattcaacatctgatgtaacttcttttcggatgggcgttgacccatttgcatcatcatactacgaagcatttcttcactaattggtggattttgcttcaagtaattttgcatatagtgccgggcaccgaagaaaccaccagttaacccaaccaatacgccgataacgacgattaaaatccaaattcctgtagacacagtcattcccctcccttattacagtcttcattaaactagtctacacaaattaataataaaagaaaaggaaaatttgtcagttgacaaattttcctgaaatcggttaatcatctcgaagaccgcgatcgcgttgcacttgacggaccttttctggcgtaacctctttaccatctttatcataaacctgaagcatttcaacttgttgccgaaaaccggcgcgaaattccttcaagtatttttgccgcaactcttgacgttcggcttcttctagctcggtgagcccctcggctttcgccttatgagctaactcattgatccgagcaagcaattcttttgaaatcaaatcagcagcccctttcactcttgaaatatacacgaaattagaccctaaatcaattaatagtgtttgtcaaccgaacatttgtttgaaagctatgaaacgctatgctacaattggtttaaccaataatgaaaataaaaaatgaggtgccaagatgagtaaaacatcggaaagcaaacaaatggccgttcttcgctttatttatgaacgtgtcaatgaaaaaggatacccgccaaccgttcgtgagattggtgaagccgttgacttatcttcgacttcgaccgttcacggccacatttcacggctagaaaaaaaaggttacatccaaaaagacccaactaagccacgtgccattgaggtaacgccagccggtttcgaagcactgggcgtcgaaactacgccacatcaaattccggtacttggaacggtaaccgccggccaaccaattcttgccgtacaggaagcgacggattattttccaattcctaaggaacttgaatcattcggtggcgaccttttcatgctcaccatccgtggcgaaagtatgatcaatatcggtatcatgaatggtgatcaagtcattgttcggcgtcaaagttccgctgacaatggtgatatcatcattgccatgaccgatgaaaatgaagcgacttgcaagcgattcttcaaagaggccgatcactaccgactacaacctgagaacgacacgatggccccaattatcttgaacaacgtctctgtattaggcaaagttgtcggtttatatcgcgacatgctgtttcagtaaactatcacccacaagatgacaattcaatttgtcatcttttttattcgccagtttttagagcaggttatttgtgacaaaagcacgcccctcattccggattcaccttgccataatcccgtgatgctcaaccgattgccttctgaataaaagagtcatcatcccgattcgtcagtatcaccgtttgtaaattggcaatccgccctctttcaagcctaatcgaagcgtgatacctactcgtcgcacctatttatcggtagctcgcaaatataccatcccgcttgttgtaaacaaccgtgcgctgagagatacgctgcaagcaccttgcgccaggcatcaacactatcccaccgtggcgttactgtgatttggtggtagcaccattgctattgaaccagcggcgcctgattctcccggtgtatcgacagaaaaagtgctggcgtcaaattggttattagtcggatctcttttcaaaatatttcaaatctgtgacgaacagccaatagttcaatggtataatgattatactattttaaacattgggagttggttacatgttgttcctagccattatgggcttgattgtttttctattagcattattttccgtgatttacgcacgtcaaaccggtggtggttggaaatttctaacactaattacggtcctcagcgccctggtcaccatctacgcggtcgttaaattgccttactggccatacaaccagtcacagcaatcgacgcgcaaagcatcatctagcacgagtactagcgctagtaccagcaagtccaaatcaacgagcttgagttcctcacaagttgtttttaacgaagctagcaccaagcgcgcggccgcaaccactaagttgaatgaagaaaacatccttaaacaattgcaatccaattatcaatcaattggcaccgttgcattcaccaagtcaacgaaaacgtatacgattacgccaaccaataaaaaatacgttaagtctttgaagacgattaaatcatatccatctcaaaatcaaaaagcaatcacgacgattacttcaaatttcaaatcattgtcaaaatcgctcaagaaaaatcttgcggctggttataccattcagttgctacagccagataccactgacaagacgctgttgagtgtcaaagatggccagatcatcaccaacaacttcaaataacaaaagtcacttgcctagcatgtttgctagtaacaagtgactttttcgtttaaacttgtcgatccaaatattggcgttgttcgtccttttgaccggtcaatacgaatcggtggggatcatcagcataactgaccgactgatcatcagcccgccattgcagttgatgactaaataaggtctcatattccaccacactaactcggcgccgacgagccaaccgttgtggtaagccatgatctaagccggcctgataatccggctgaataaccccggtataaaattcaccttcggcacccgagccataactgaataatccgagtcggttccctggttgtaactgaggatcagtcagtaactgcgataacaagctcaaatagagtgaaccagtatacaagttaccaacttgtcgatttagctgacgcgcatgttcgaagtgcgtcaaccactgggcttgtttctcggcatcaactaatggtaacacgcttcgaagcgctttaagtcccatctttgtatatggcaaatgaaaaactaaggccgtcagtgtgtctggactagtttgagtcgtttgcaagtaattcttaaacacatcttgaaaataatcaatatagatattagacgagtatttgccgtcaactagggcttctgtatgatacaatggtcgccaaaagtccatcacatcttcgctcagtagacttgactcagtacccagtgctaatactttaggatccgcactaattaacatagcaaccgccccaccaccttgagttggctcgcccggtgtgttcaatccgtagcgtgccacgtcactaccaatgaccagcgcctttttatctggatgaacacgcacgtgatcttgggccagttggacaccagccgtcgccgcatagcaggcttctttcatttcaattgttcgaacccgctggctcaaaccgagcaacttagcgacgtaaatcgcactcgctttggaattgtcgatccccgactcggtaccgacgactaataaatcaatagccgcaatgtcagtcgctgtcagcatcggtgcggcagcattagcagctaacgtcactgcatcctgactcggcggaatcaccgccattttagactgaccaataccaatcaaatacttatcaggttctgcctggcgagctgtcgccagttccgccatgtctacgtataaatgtgaagttgcaaaatgcaacttgtcgattccaactttcacgtcttttcctccaatttgttaatgacaataagggattaatatgcacgtccgcgtggccctaagtaatgaaaatcagggtcagttccgacccgatagcagctgaaagcccgactaatttcattatgaaaagtcacaacaattgccggtgtcgcccaagtagacgccgcccaaaaaacggtgtcatcaaacgcccggttgtcattcgggtagcggtgatagccttgtacattgtcccaaatggtgccgtgcgtattcaaccaatcttcagcaagtccggcgtccacctgcatcatcacgtcttgattatcagcaatcaaactacttagtttttgccaatcgagttgccaatcatgaatatggggattcggtccgcgtgtgccaagcggtgtatgccccaatgcgatcggtgtcaattctacaaaatccatcttgaccaccccgttcgttaaccatcctaagatttcttaactattatagcatttcacgacaaaaatactgcccgcaattgcttgacctgggacgggttccataatttatgctgttattaaataaggcgattaagacaagcaccaagtaaggagcgcggtaaacatgtggttctcacatcatcaaaaacgaaatagtcttcaggcacccgtcgccggtacttatacggtgattcccactgccacatcaccccaacaaatcgggctattagccatacaaccgaccagtccggtgattaatgccccgattgatggtgatatcattagcctgtcaccctcgcgtctcgttatcaattcgctgagcaatcaacatattgaactgcgtatcgaccggccgaacttccacaacaagtgtacctggcaagtacgcgtgggcgattccgtttcaccattaacaattgtagggacactttatggatccttaaaagacgtcaccattgctgtctatcgaattgataccattcaggccactaattgggtttcgctcgcaaataattagctgtttacggctatagattcatatccgctaattgggcatttcggttgtcaaaatataaatttgacggttgtgaatatttctaagtccaccttgacacccatcgcccaatctcaaaaagataaatcacaataatcacttttccaacagcttcaacgggccatgctactgtgcccagttggagttgtttttttgcaaactactcaacactgccaggtgtgaaatttgaaataacatgacgcatcgctgtcgacgtacttgattggtgatgtaattgacaagctatcgtgacatcattacaatttttgtggtttgatatttgattgctttataccttaattcaagctatgatattcatactggtttaaaattcctttctttattaatcagtaggagccctaattaatagatcaatctaaaaattataaaaaggtcggatacaattattatgaaaaccatgagtcttgttgttccatgctataacgaggaaccaacgattgaaatattttataacaccgttgaaaaagtcttggcagataatccagagtcgttcaaggatatcactactgaatatgttttcgttaatgatggctcatctgacgacactttgaacgtactacgaactttaaacgccgcccatcctgacactgtccactatgtctccttttcgcgaaattttggtaaggaggctggtttattagccggcctggagcacaccattggcgattacgtcgccgtcatggacgttgatctacaagatccaccgactttattgcctaaaatgctggcaatgcttcaaaccggtgactatgactgtatcggtacaatgcgggaaaatcgcgttggtgaaccaatgatccggtcattcttatcacgctcgttttactcagttgtcaacaaaatttcaaaagtacaaattattccaaacgcccgcgattaccggttaatgacacgtcagatggttgatgctattttggaattgcctgaatataaccgattttcaaaaggcatcttcaactgggtcggtttccgaacaacttatttgaagttcgaaaatcagccccgttccgctggcgagacacactggtcaatttggcaattattcaattattcaatggatgccatcgtcgacttctcagatgtacccctgaagattgcgaccttcaccggcggcttgctctcactaatctccattatcagtatatttgtcgttattattcgtaaaatattatttgataacagtgtcagtggttgggcctcaaccatcacgattatgctcttaatcggtggcattcagctgttctgtctggggattatcggcaattacattggtaagatttatatcgaatcaaaacaccggccccactacatcgtgcaggaaaagaagtaaacttttcaacctaaactgagacgcatacgaccatatcgggaaactggtatggtcgtgtgcgtttcggcatctggatgaagttaaaggttatgaatgaaattattatttaaaagctcttttggggacatcagtccttgtcaagttgatgaatgaaataatatgatttttaattacttttcaaacggcttcatcgcggtattcaaatgcggtagagccgtttctttgtactattcgtatgatttcattaaagtatcaaaagtcttaaacgtgtaagttaacccacgatcagtatgagccatcagttggacatcaccagcgttcttaaaagcctgggtaaaggcgtcaaccaccgcctcgctggttggctggacttaagccgtaaatcgggctttgtgcttgttattagcccataaacgacttcggtggaatcggataatcctacttggttagactgagttacttgatttaatttcttacttagtttgtttgatgcgttgaggccgcttaatacaactttaacattttagatggagtacagatacagacatcaagtgtttaactgaaaacccaaaaccaatcgattcatgatgaagccacttattatagactgagcgcgacaaacctggcttgctaaacaaggtggcctgaacaccatgaatatccgagccgacggttttgattccttgataggctaatttatgttgtgcattcaatctttgtgctgtattttttggacttttttaaaaagaagtcaaacctcctgctccttgatttgaatcttaagttgacgtttcttgagccttagtcgttcaacctcagtcattttttcaattggtttcgtccatccaagccggtctttaagtgcgatgtaaccattggtggtggttttgagcatccagaaacggatttgctgataagatacattgtaatgtttcgctgctcgggaatatgcatgttcactcaccgtaatgtattcaacgattctaatgcgttcttcaaaagttatttttctactcataatgtggaccagcaattcattgatccggtcctccagccgtctagtacttctaaggccaaatctgatttgaatatcccacaaactactttcatcattcaagtacgctgatatggcctgccgcttaatctctgagatatatcgaatccaattgtgctgttcttttaatccttccagaccatcctgcatataaaaattttgacatctgatgaaagtacttcgagcgataccacacgctttaaaacacgttgatttagtcaggttagttttttcaagacccagaataatagctaatttttctgtgaccataaaattggttctagatataataaaatctccttaaaattgatagatgaagtatatcatttcatctatcaaccttaagggggctatagcacttaaaactgtctggctcgttttggttactgaatagtgtccacttgctaacgattatcggaatctaatgtaccgtgtacatcgtttcagtcctatctgaaactcggaaaccatttttcaacggcaccgctgctggtaatttaccaatagtagtattaccagcatgacctacgtacacatgcgattggccataatgcgtatcagccttagcttcatcagccttactttcaacgctttcatcgctggcataccgataatgtccattggttgtaaaggtctgcgaaggcaagtctggccgtagcccagcggcggcttgtagttgccgactcacctgtacgcgactgtccggataaacctctaccatactacggccagcaacatcaaacgttcgccactgaaatgtcaatcgttttactcgatatcgcttaaaagttttacgacttttaaacagtgttaacatatcgtgattcgtcaaattagtcctcatttgatctttcaaatcaccgacaactttggcccctttagacgaaagcccttcctgattcaagcgcttgaccattgcgtaaaagacggcttgctgccgaaaaccacggtgttgatcgttgtcaatatgtctttcgcgtgcataggctaatgcacgtgcaccagacatcgattgcaaacctgctttaaatttttctggttttccccagtaatcttatccgataaaatcacgatcaacattaacttcaacgggaccaatatcatcgattgccctaataaaaccatcccaattaacagttagataataatcaattggtaaattcaaataatgttcaacggtcgctatcgccgctgcatcaccaccataggtatacgccgattcaatgcgctgataaccatgatattgctgcgaatggatcttaacaaaagtatcccgtaataaactacataaggtcactgttttagttttatggtttacaatgactaccatcattccatccgtgcgcgttgtcgataatttgcgcttgccactattatctaaccccatcaataaaaaagtactgaccggttgctgggtcaaattatgatgcgacttaataactcgtgactcatggaacgagtgcaacatgtcaaataaccgaataccttgaattgtgaaagctactaacataaaggttatacaactcgttactagtacaattagtcgttttctttgccatttaggtagttgccgccttctcataaactcagtccccccgcatttcattcatatcgcgcttaaattgatcagtaattgccattgtcttggcccaaatttgttgctcagtacgttgatttctaggcgtcttaatctgataagtgttcataatttgtgcaggtttccctcctagaacataaatgacgtctgaaagacgaaccgcttcagaaatattatgcgttatcaaaacaatcgcttgcattttaaatttcctgcgttcccataatgtgatcaaatcttgccctaaccgctgccctgttaaaacatccagtgctgaaaacggttcatccaaaaggagcagttctggctcaacagcaagtgcacgcgcaaaaccaacgcgttgtttcatccctccagatagttcataggggtacgcatttttcaacccttttaaaccaatcaaattaattaaattgtcaatttgattgtcaacatattgacagtcagaattaagctgactttctaggccaaacatgatattttgacgtactgtcaaccatggaaatagcgcaaagttctgaaataccatactcatacggcgattaggagccgtgactaaattaccatcaaaagtaatggcgccatagctgggccgaataatccccgcaatcattcgtaatagtgttgattttccgacaccagacgaaccaataatactaataaactggtgggtttgaacctgcaaactaaccgcttccaaaatcagttcagactgccgttgttttgaaagtataaatgactttgaaacgtgatcaacatctaataaaactgcttttttcaacttaaactcctcctcgtattaataatgaaagcgacgttcagcaaatcgatataatggttgccaaatcaacacaacgcataacccaacaatgacacaaataatcagtactccagttgcttctgcaggcttattattgatattttgggcaatgtaagcaccaagtccagtaaccgcatactggtgggtaccccagctaatcaattcagccgcaatatcagcattccaggctgccccagcagcattaataattgcggtaatgaacgatggaaacagtgatggaattaaaaagtgtgtccaccaacgccaccctgacaggtgaaaaatattaacaacatctttgatatcactgggaattgccagataccccgcgataatgttgaaaaaaaagtaccattgagttccagtcattatcaatggaatgacccaccaatgctgtgtcgtccctgtcaacgtaatcattaatgcaacaattggaatataaatatccgcgggaattgatcctaaaacttgtccaaccggttgaatcagttttaaccgccgcgcattactagcaacccatacggcaagtggaataaaaataagcgccgaaagtaaaacagctatcaacacacgactagttgttaggaaggtccatttaaacaaaacactcaaattaatccaatcaagatattttattagtaatacacccaagcgatatagaccaacagctattactagccaccatgcaatacgccaatataccgtatatttttttaatattcgtataatccgtgaaaagcccagtttttgccattgctttggagcaccatataaccaccaataccggatatgacgatgtaatcgcttaactaacagcggcactttagccataaccatcaaatcatagacttgcgattgctgtggtagttggctatcggtactcgtaccgtatttataatgtgccgttcctttaatcagcggttgaaaaataaacacattgaccaataacacacagataactaacgcaatcactgcattaataacagcaccaaaattagctgtatcaagcgcaatctggatgtatgatccaattcctggtagcactaatgtttcatttttaggaaccacgatcgtcgcttgttcacaagcgactagggcaaaccaagcggccgattgagaaatgacaatattccatagaatgcttggcgtcgcataaagaaattctaagcgccagaatcgttgccagctattacagccaaattgcttagccactgtcatcaagtcttcgggcgtaacccgaagtgactgatagagagccaacataatattccaggcctgtgcagtgaaaacgccgaaaatagcaacggcctcaacacccagcacattattgggaaacaatcccatgaaccatgcagttgtaaacgttaaaaatcccaataacggcactgactccaataaattaacaatcggcaaaataacatagcgtgcacttcgatagcgcgctgctaatatgccaaaaatcaaagaaaacaatattgagtagcccattccaatgaatagtctcgttgttgttcgtaacgcagccgctactaaatgtgacattgttaagtagtctttacctcccgtagtatctaaataaccctgagtgggtaatcgactgagcggcaggttcatcttggcaatgcaccagccaatcataagcaatattccaatacttagtccaagccacatcatcgttcccaccacagaacgtactttaatccctctttttaaacttgtcatggtgactcctttccatgttcaagttgtttttaggcaaataaaaccccattagcaaattgcagctaatggggtaaaaaactaaaatggataacgatttttgcatcgacgcattcattgagttttagcactttaagacgtaagaactagtctagttatcttgaaagagccttaattcggcaaattctgctttactcattcctgtctctcgacatttctgggcgataacctatattcttaaagtaacctcacctaattgcaactgatttttattgctgatgtaatcaacaatgctatcatagtttcaagatctttaaccgtcaatagaaaccagctaatgataatcattaacaagtgattatttatactttttaggtttcctttataatcgtaactttttcttaactatttatctctaaacaaattactcgtactgtctagcttgaaatttggactttaattgccacaaaaatcctgttacttagtgaaaaattctcggtaccgaaaaaatggagcgcacgttaggatactgtgtcgcaagaaccaagccaacccccataaaatcgccaattatggccgaacctccctgactaacaaaaggtaacggaattcccgttaaaggtaacagcccaatcgtcatgccaatgttttcaaacatatggaaagctagcattacggctactccagtggaaacatagacataaaatcggcgtcgactagcgaatgctgagcgaaaaattagataaaacaagtacatgtaaacgataagtaagacactgcagccaatgaacccagttgtctcaccaacaaccgaaaaaatcatatctgattccctaactggcacataaacagcgttatgagttacaccattcccagttaatccacccaccccaaccgctcgcatactttgccacaattgatagctttgatccgagacgccattgcttgggttaagccacgtattgatgcgatcaaactggtacaatttaaatccgatatgagataacagagattggcccgtgctcgatgtcgctaacaaaattaaagcaaccccaatggatccggccaccaataacacacgccacaaaaaactaaaccggcatggtgaaacaatgagcataccaataaaaattgtcagaaaaactaacgtcgttccaaaatcattgatgattttcaacgcaacaataattggaaaagtgtaaataactaagcgacgtgtcaaccgccaatccgcattaaaattattgtggggtcccaactgttgatcttgaacgattaaccggcccatcattaaaatatagagcggtttcataacttcaactggttgaaaagtcagtgtaccaattgcaaaccaacttttagcccctgtttgaacataatattctcgactatagaagaccaataaaagtatcaataacagcatgccaattgaatagccaatcggggcccactgcatcaattgtttttcacttaggtgaagcatcgttgtcgctatcaatgcacccacaaggtaccagagacactgcatcattgtcgtccgaacaggatcaatcacttttaaatcatgcagacaagcatagtaaacagcccacataccaatacaacagagtatgatgacacataatataatcccccagccatagtcgctaatatgtttatgctcttgccaccgaccaagttctctattattcatttgttaccccccataaataaaatttataccgggcttagtatagcggtaaatccaagtattttatattttaagtggcttttttatgcttaattaatcgatttaaccggattctaaatattgcattaaaatcttaataatcgtggctaagcctcttgctagccacgataaattaattgatacaacatttgatcattattacggttaatattttgcacgttgttgactaatcgtcttaaaatcttagcgtcaatctaatatttgacgctacctttaaatcttttgaataaatatttattccaacagaaaattatgctatacttattaagtaccatatggagagttggcagagtggtaatgcaccggactcgaaatccggcgaaccggctaataccggcgcgcaggttcaaatcctgtactctccttattaaaatagtagagaccagccagtaaaaacaagaatcccaacaagcattgatttgtcgggattcttgttttttatataattcaaatcaaacaagtcaatatcaacatggtttgctacctactatactgtttggaaatggtatggatactactattacaaaataggttttagacttgagctactcttgcctgctccaaaattttggcactcaatatcaacgctttcttgaaccacctagaggttttctatactattggtttggtagattgtaaaattaatccgaacgctgttcggacaaaaaagatcagcttcctttaaaatggtgtttaccacaaacacatcttttaggagctgatcttttgtctagtataacctattctgaacgaattaaaatcgaaaccttttgtgaactaggcctgtccaatatccaaatgagcgatcgcctaaaacgatcacctgccacaatttcttatgaattagctcgatgtgaaccttaccaggccgaagtggcccaaacagatgccgaatacaagcggtcacgatgtggccgaaagactaaattgaatgacaaattaaggcaaataattttaaaccatttacggctaagttggtcaccagaaatgatagctcacgaatttaaactagcgactaaatcaatttataattggttaaatcaagggaaaattgagttttctttaaatgatttgcctgaacatggcgtgcgccaacggcgtaaccttgaccaacgttctaaatataatcaatcattaggacggtcaattgaacagcgacccatcgtggttaatcgacgtaatcgcatcggtgattttgaattagatacaattgttggcccccgtgggcatagtaaggcagttttattaaccttaatcgatcgcaaatcacatttcctttgggcctaccgattaaaaaaccggacagcaggaactgttaatgaagccctaaataagtttctagcaacttttaatggcccggtgcatagttttacggtggaccgtggcactgagtttagcggtctagtatcacttgaagcacaatacggtattaagacctattactgccatgcttatacgccagctgagcgcggcagtaatgaacgatttaatcggaacttacgctatttttatcctaaggggacttattttgagcacattagtgctcaaggcttgaaaaccaccttactcgaaattaatcagagaccacttaaaatacttgactggcaaacaccttatcaggtcatgctgacaaatttgtccaaaaattcggattaaatttgcaatctaccgtttagtaacatattctaaagctgcttctttaattgttgaatgccaattcaaattcattcacatcaatgccttattaaacatcggcacttgaaataatcataatgatcaacaacatcaatcaagtaataccattctccactaatccacaaaaaatatccgtcagcccttgccaacggatacccaattacttctgttcacgtgcggcttgaccaaaaacaaagaacgaaccaagaatacccacgcatgatagtaaaaataaaatgccatagcacagtacatcccccactgtcactaaagtcttcggaaaaccggcagttgagacccatagaaaaatcacgcttaaccaaaaccaaaatgaacgataaaactgaaccggtcgacgtatccgcatgacgctcccccctaactcgtgattccaatgaaataaccgattggaataacgcctattataggcagtgcgcaattaggtacaagttctgaatactcaaatccgacgtttaagttacaattcataaccgattacgtttgttaagtgccaatccgattaatatgccccctcgcaacctcaatcacgacgagccagtttacaagcgataatcataaatcggtcttcaaacgtcgtgacgcgaccattaatggccagtaaggattgtaactgatgtaatttaggaagcatccgtgccgcgtaggcttgctcagcccgcagaatttcaaatcccgcagcctgcatttgagccattaccgtcaacaactgattgtcaggatacgccggttcgtaatgctcgtcaaagaatcgtgacaacgcataattattggtcgcaccaacttgctgagtcacaaatcggccccccggctttaaaacttccgcaattcgcttcactggcatcgcaccatgactattcgttacaatatcaaatgtcgaatttggtacggccgtcaactgttcggcggcatctggatataatgttatcccctttttaaccaccgtttgcttcaacaactcaatatttggttgccacccctcagtcaccgcagtcagcgctggctgatggttaaaacgccccatcaattcaccaccgcccgtatcaatatccaaccatcgatcatcggcacttagatgctcacgaactagggcagcgtaatcccacggtaagtccgcagtctgccaccggccagccagatgactaaagtcccagccgtgcatggattgctgcgcttcttcaaaccaacttctttctaaagctgtcatattttgcctccttcgtttcctgtaaaccagaccactcatcaaagtctccgctggcctatttcaatacgaattatgctatgattacaatatctttaaaaggaggttcagtcaatgacacaattactggtcacgaccactgaaaattttccggggcacccctatgaagttatcggtgaagtctttgggctaaccactcaatctaagaatctggtccgtaacattggggcgggcttaaagggcctagttggcggcgaaatcaaggattacaccaagatgctcgaagagtcgcgcgatgtcgcggtcaatcggttgcgcgataatgcaagtgccatgggtgcggatgccgttgtgatgatgcggttcgacaccggctccattagtcaggatatgcaatcggttgccgcatatggtaccgcagttcgttttatcaccgaagatttgaccactgacaatgcttaatctgattcgagactaacgaaaccgcctgccggtaatctgggcaagcggttttttagcatggtggcagctgtttgtataacacaattataattttcgtcaccggcgaatgaacagacaaccaccacaagctaacagtaatcccatggccgtcaaataagccgcttctgggctcacgatattatccaacaagaccaatccaacacttccgattggaatcgaaatcgtcgccaatgaatttatgatgccgcctaagctcccaacgatactttgatcggccactttcaataaactcgccatcaatttaggatttgcttgtcccatacaaaatcccccaatcatcatgattgtaaccactacccaatagttttgccaaaacaacagattaataaataaaccctcaaacgccacgacggtagttaacatgacaccacgaaacgtccacctctgaaagtaacctgtatgtaacaaattccctgcaaccgatccaaatacgtcagcagtattcatcacaagaattgcgactccgaatgaaaatggtaactgcgtcgcccggtgaatcaggtataaattcaatagtgcatcgacgcttgcacccaccgcattcaagaacaagacgctccccaatagcgccaagacgttcatgtgcacccccgcttccattgcttgtcgcacttgtcgtagcagttgacgaaatgtcgacgtcacggtgacagttgcggaaggtaattttagcgtttcatacccagacagtagcaccagaccggcaatcaagaacgtgattgcattcaaatatcccgcgagacgataatcgcccgttgcggccaatagactgacacctaacgcttggcccatcgtctgcattaacactccgatgccttggttgatacctaaggcctcttcttgtaactcagacgcgactttagcttgtaataatggcattcggaggctgccactcaacatccccaacacgtctgaacacaaattgatgacaataataatcaacagcaacccgacctgtttttcagtaataagttgcgctaacacgagatataatgccgcttgaaaaaatttcaaacctgctaaccacccccgcttattggtttgcgagtctgccaatcgaccagtaagcataccaaaaataccaggaagcacagtagccaccgaaactagtgaaaccatcaaatttgcttgtgcaaacgttcgcgcgtacgttaatagaataatgttaaataggctggtaccaattgtctcaaaaagatcagctactgttaacgtgacaaacgctcgattacggcctagatttttcataacgccacttccaatttaatattatttatcgtttaaataaatttaaatgataaaacaactttaatcgtttgatttctatttgtcaaatggttaagctagtattgaggtgaaaaacatgcccaaaaacacactggctcagtttgcaaagttaatggccgatcccaaggtggccgctatcttaaaagccaccaaatctaaaactggtttaacaactaagcaaatttcggcccaaactaaaattcccaacaatcagttgtactacaccatcaacaaaatgcaggatgccgacttattaaccatcgttaatcaagttcaggttaaaaatctaactgaaaacttctattccagtgcccacctctcccatgagacgccacaggaattggcagatcttgatggtctcgatactgatctgactgacatctccggcacgtggactcaagcccatgtccaacaagttttacaatggatcatgctattgaaccacgactttaccgaagcctaccaggaagagatgacccgcaagcaacctgacaagtcagccatttttttcagtaacgcgatcctaaacctttcagcggcaggcgagcaccagttgcgcttagatttgatcaaattgcttggcgatgctgaaaagaatgatcctgatcctcagtcaacggacaagcgtcaggttaaactactcattgaaaagtggcaataattagaatatgcaattgttagtctttttggcttggctaccaaagaatcactgactatccaagctaactaacgaccaaaacaagggttagcaaaaaagctccgaatgactaataaatcgtcattcggagcttttaatattggctttaaaattgcatcaagctcaacatatcataatctttaatcttatcgcggccgtgcaactctttgagttcgaccaagaaagccgtcccaaccacgttaccgcctaattcttcaaccatttgaatcgttgctgagatggtcccaccagttgctaataaatcatcagtaactagcacattttgtcccggcttaattgcatctttatgcaaataaagtgcagactgcccgtattccaaatcataagtcgctttgaccgtttcgcgtggtaacttacccttcttacgagcaggtgcaaaaccaacgcctaattcataggccactggacaacccacgataaagccgcgtgcttcaggcccgacaatcatatcaacatgtttatcacgcgcaaattgcacgatctgatcagtcgcttcacggtaagcttccccgtcagccatcagtggtgaaatatcgcgaaaaatgattccaggttcgggatagtccggaatactagccacatacttttttaaatctaatgccatttgttcttaacagctccttcaattcttaaccgcagcctggttcttcacccatacttggagcgctgcagatttactatataaaagcgtttcttcagcaacgatttgttgttcgcgcagctgataactaggggcgtgatgtaaatccgcttttgccggattcgaaacgccattcatgacaccatcatttattttaacaaatccgacctcaaaaaacacctgaatcatgaaaataagcaaatttcgttcaatatgcagatgcttggccactaatgttaattgatgatgaatatcaacatcatggtgcgctgcggtaaactggaaaagtttcgcaaactgcgcgcgatttggcattcccgttaaataaaccgattcttgccgatataagtagagcgtcagctgatcgagcgcaattgtgctgagtacctgggtcatatccgccagcgtgtcaggacaatcgacaatgaagaccgcttgattagccgtcacggcagtcagatccgttttcgtatcccccacccatacggcttgcgcttgggaacctaaatactgttcaacttttttcaacagacgctggtggaaaaagaggtaaacccccggtgcttgaaacaaatgggccgaaagatgttgcgtccgggcgtcgatcacctgggtccccgtcactgcaatatccttaaccatgatttggggctttgtctgaccgttccaagtattttcactcaactcacccactaacgtcacatcggtgggactcgcctgaatagccggcaaggcagtacccatcgaaaaaccgatagcatcaatcgtattggtgccatcacccagttgtaatttcaagtgttgctgatcactaccaatcgcgcgtgcttgcggaacagtcgttggaactaattcaaacaacggtgccgggttatccgttccaaagggggccaacgcttgaatatctgccagagttgccaaggttgcctcagctaatggtaacgtgccgtcaattggtaaactgacttgcgcattgtctgctaattgctgactaaccgccgccgcttccatcgcctctttaagcgttgctaactggtcggccatgacagttagtccaaccgccatatgatgaccgccaaaagccaccaatgactcacgaactgggtcgattgcggcaaataaattatacgcttcaacgctccgaccactacctttgagccggccatcatcatcctcatttaacactagggttggtttgccagacgtttcgaccacgtggctcgcgacgattcccaaaacaccctcgtgccaaccatgcccggtaataactaaggtttggcgggcctcattttccggcgtctgtgcttgctcgattgcactggcactgattgtcttgaccaagccttggcgtttttcattcaattgattgacctgcttggccagcgcggtcgcccgctcatcgtccaaagttgtcaataattctacaccgctctgcgccgactgcagacggccaagtgcgtttagccgaggggcaataccaaacccgatattggtctcggtcaatttatcgggaatcaatccggcttcttgaatcagtgcggccaagcctgggcgggtcgtctgctgtaagaccttcaggccgagcgttaccaaagtccgattttcaccagttaagctgaccaaatcagcaaccgttccaatagcagccagatctaacagttcctcgggtacttcctcaagcagcgccgttgctactttaaacgccacaccggcaccagaaagaccaccaaatggataactgccctctggatgtcgtggatggacaatggcgtaagcgtgcggcaattcagtcggtaactcatgatgatcggtcaccacgacatcgatgccctgttcctgcacttgattgatgaccgcatttcccgcgacaccgttgtccaccgtcacaaacagcttcgttccagccgcaatcagccggtcaaaagcagcctgattaggcccataaccatccttgaaacgatctggaatatagtaattcacgttagcgccaatttggtccaacgtttcatacataattgacgtacttgttaaaccatctgcatcataatcaccgtaaatggtaatttgatccccggcaataatcgcctcttgaatgcggtcaacggctttttccatatcgtgcatggtcgttggatccaacaatggttgttgatccgcgtgcaggaatggagcggcttcttccgccgtattaatgccccgcattattaataaccgggcaactaagggggtcacgctggccgcctcagctaacttatcaacatcggcttcatcaacggccgttgttaaacgtggcacccactttttctttgccgctaacatggcatccttcctttcaacaacttacttatctgctggcgtggttggttgttctgccaccgctcgtttttgtttacctttattattcaaacgcaacgttaattgcttattttcggcagtcaacttgtcaatcttagcctgggccgctgctaaagcttcactatgggctgtccgttccttagattcattgaccgtcgccatcagtactgcggtaatgacacctaagatcaacgtcaccacaatgaccaaaatcagtggccaatgaactgctgtaattccaaaattgattcgaactggttctacgtttaaaattgcaaaaataatcactactagtgcaatgactagtgcactcactaaccgccattgattcttcattaaattcatcccctatttaaaattaaaaaccgtccccgtcagccaatccccgagcttgggtgccagctgataacctaaattagctgcagacatcacccaaggccgattcagttcgcgccgttgatgcccgagtttgcttacaatcaattcagcaaacttaacggggttcaatgccagctggtcgacccggtctaaatagtgccccgtgggatccacaattttgaaaaagtccgttttaatgggacccggattgaccgtcaatacgttgacatgagcatccttgagttctaagcgcaacgcattatcataagcaataatggccgccttactagccgcataaacggctgatttaggtgttgcaattttgccagccatcgaggcgatgttgacaatttcacctgcatgttgcttgaccatccgttgcgcagccagttggctaacatacatggttcccaatgtattgacgcgcaacattttcgccatcatcggcgcatccatagtgatcaccgtggtcatatcgccaaaaccggcggcgttaatgaccacatccaattgaccaaatagctcatcgatggtcgtaaagacgtgatcaacgtccgccacgtgacccacgtcacaagtaatcgccacggcctgcccttttgataacagacgacattgatcagcaacctgtgttagccgttctcgccgccgggcggctaagacgacattggctccctgactcgccacagctagggctagttgctcgcctagtccactagacgcgccagtaaccaaaacagttttacccactaagttcgtcatttacttgacctaacctttctcaggtaatggaatatcaattacatcaaagtcacgaacgactttcgagtgactaaagactttctgtgcttgtttttgtagttccttactcaacttacccgtgtaccgagccgagatatgggtcaacaatagctgcttaacaccggcctgttgggctacctgggctgcttgggtactcgttgaatggtaatagttatgtgccaacttaccttcatcttttccgaacgtgctctcatgaactaaagcatccgcatcctgtgccaagctgaccgcgtgcggtgtccgccgagtatcaccgagaatcgtcaccgtccgccctttttgtggcgcagcgatgtaatcttgaccattaattgtccgaccatcaggcaacgtcaccgttttgccggcttttaattgaccatagacgggaccactcggaatgttcagggctttgagtcgatcggcttgtaattcacccgggtggtccgcttcttctacccggtaaccaaaacaagcgatccgatgatccagaggttcgcagcttactttgaacgtcgcatcttcaaaaactgtctcagccttcgtgatttcatgaaacttcaatggatatgacaaatgggtgccagagacccgcaacgccgtttgaacgaagtcgcggacaccgactggcccataaatggtgagtggttcgtccccgccttgaaaagaacgcgagctcaataaccccggtaagccaaagatatgatcgccatgcagatgggtaataaatatttttgcaattttgcgtggttttaacgtcgtgcgtaaaatctggtgttgcgtcccttcgccgacatcgaacaaccagacttcatttcgctcatctaatagtcgtaatgctgtgctagtgacatttcgaaatttgcccggtgagccggcaccggtacctaaaaattctaattgcatatttttgttcgtcctatctatacagtctgctaactattttaccgaatctagcggcaatacacaattgttagcactgcaaagtcatggccggtcaacaccgtgcgctcaccgaccgcaattctaaaaagcaagcgacgttgggcgactcctcacaattaacaggaagaacacgaacaacgctgctcattttattttaacatgtcaggctaaaattatcgcacttggtttcaagattccacgcgccaagactgcctgccaccggtgttatctataatcaaaaaatgcacttttccgggcaaactgactatgacgggttgtgaccgttttcattcaacccgtcatcgccggcaaatgaatcctcagtccatcttgcttaacccaattgattatcgtatacttgcttacaaatcgtctgaacaagaggtaaccgttatgcgactcatcgactttaacttatcaaccgctgatctacagcaaactttaccactgtattgggaactaacgactaatcaaatctggccaatccaaagtgttacgctcgtcgatcaccagctggttttagtagcttcaaaaagcgcgctcccgctgacactcgaccagttcaatgcgcggacgcgccaaatcgatggtcaaacgcagctctgtattcaaaccccaccgcgcccgcgccgattatttggctatcgcttaagccagcagcgcttactgtttggctgagcatctaatcgcacgtcagctcaaaaacagcgtcgttagttaaaattctaacggcgctgtttttggattgttcattattttatcactagtctacctatcagactgtcgtaacgacaatcatcaactaattatgtcgtcacaaaagtttagtccataaactggaaggagtagtccaagatttgaatcgtatcatcattcttggcaccagctgcacgtaaggcatcatcaacacccatcccacgtaattgtcgagcaaagcgcattaaactttcttcatgatctaaattggtcatcttaaagagccgttctagcttatcaccagacaagacgaacaagcccggttctggattatcaatgctaaagtctgcatccgcttcagtcgtgtaatcacggtgcttcaagtcgtcaacacccttgattgggaattgtggcgtcgtatccaacaaatcagccgtcttggctaacaaggcttttagtccctgttgtgtaatcgacgataccggatagacggctggcgtgtttggcaacgtatcatccgtcgctaacttcgccttaaagtcttccagattagcttcggcatccggcatatccatcttagtcgccaccacgatttggggccgcttcaagagatcagggtcataactcgtcagctcgtgattaattttgtgataatcctcaaacggatcgttttcttctacaccactcatatcaatcagatgtaaaataacgcgcgtccgttcaatatgccgcaagaattgaatccctaagccgactccgttagctgcaccttcgatcaaaccaggtagatcagccataacaaagtcacgaccgtcatccaaacgaaccatcccgagattaggcactaaagttgtaaaatgataggccgcaatcttgggcttagcactcgtgaccactgaaagcagtgtcgacttgccgactgaaggaaaaccaaccagaccaacatcggccaagactttcaattccattcgaatcgtcagttcatcgccgggctcaccattttcagcaatttcaggagcagggttcttagcgctagcaaaatgaatatttccccgaccgccccggccccccttggcaaccactaaccgctgatctttattgacgatatcgccaattaactcaccagtttcagcatccgtcaccgttgtcccaagcggtactttaataattgtgtccttcgcggaacgacctgtcatctgcttaatcattccattgccaccagctgcggctttgaacttccgcgtataacgaaaatccatcagtgtccgtaatccttcgtcagcctgcaatacgacgcttccgccgcgaccaccatcaccgccagcgggaccaccattgggaacaaacttttcacggcggaaagcaaccatgccgttaccaccgttaccggcctttacatctacttttacttgatcaacaaacatgttcttttctcccgtttcttctatattattatctacgaaatccgatcgtgcgaaattagatacctgacctagtatacaaatcttcggccacttcgtcaaaagttccacgcctaattagacagatcatctttatttggatgctatgacgatttgatgacagattttggattattttgactgtttttgaaggtttttgttgcattttgacgtttaaacaggtatattattatgcggagggatttgaaagtgcttacagaagaacgtcaacagtacattttaaatacgatccgtttcaagggcattattaaaatcaaggacatctgttctgaaactcgttgttccgagtccacggcgcgccgtgacctccaacagctagaagaacagggcgagttactccgcgtgcacggtggtgcgaagtatatgaactcactccaagaggaacccgcgatgaatgataaggtttcccgtaacgttaacgccaaggaccatatcgcgcagcaagccgttgcgaacattcaagttgatgacgtcatttatttggatgctgggacttcaaccctagccatgattcaccatttaaatccgagctacaacttacgtgtcgtgactaatggtgttgtccatgcttccgctttggcagacataggcatccaaacctacctgcttggtggcaatttgaaaggcaccaccaaagccgtgattggtcccgaagccgttaaatcgttagaggaataccgattcaacaaagtttttcttggtatcaacggtgtccacccaaaattcgggctcacaacgcccgaccccgatgaagcggtcgtcaaaaaaaccgcaattctacaaagtgaagaaagctttatcttagctgacaacactaagttcgaccacgtttcgtttgcgcgcgtcggtgatttatccagtgcaaccatcatcactgaccaactcacgccaagcgttgccgaacagtatcaaccattaactacgattcaggaggttcaatcatgatttataccattactgtcaatccatcaattgactacgtggtgcaactaccccaaatgaccctcggtagtgttaaccggttagcacacacggcgaaactccctggcggtaaaggcatcaatgtatcgcagattctgaacgacctagaccaacccaacaaggccctcggctttatcggtgggtttaccggcacgtttatcagtgatgctttaaaagccaagggcctagattgtcacttcacaccgattgccgatgacacccggatcaacgtgaagattcacgctgaagaagagaccgaattaaacggtgctggcccggacatcaccgccaaagaaatagaagccttctacaccgaattggccaatttaacgccgaatgacgtggtcgtcatgtctggtagtttagcgcctagtttaccagatagcttctactacgatattattcagaaggtcgaagctgctggtgctaactttgtcatcgacacgaccggtgaagctttgaagaaaactttacccagccaccccctcgttgtgaagcctaataaccacgaacttgctgattactaccacacgacgtttaatagccaggctgatatcattgcagcgggccaacggatgctagctgaaggtgcacaacacgtgctgatttcaatggccggcgatggtggcctcctaatcaccaaggatgcggtctactttagtcccgcaccaaagggccaggtaatcaactcagttggtgccggtgattcaatgattggtggctttgtcggcacgttcgccaaaacacacgatgctgttgaaagcttccgctacggcttagcttgtggctccgcaaccgccttctcagaagacattgcgacccgcgccaagatcgatgaaattttgccactcattaacattgaaaaactcgctcactaaagaaaggactgttaactaaacatggatatccgcgatttattactaaaagatgtcatgatcatggacatgcacgccacgaccaaggacgaagcgattgatgagttagttcataaatatgccgaacaaggtatcatcaatgatgaggccctctacaagcaagacatcatcaaacgggaagccgaatcaactaccgggattggcgacgggattgctatgccccatgccaaagataaggctgttaaccgggcaaccgtgatgtttgctaagagtaaggccggcgttgacttcaacgcgttagatggtcaacccgttcatcttttcttcatgattgctgctcctgaaggtgccaacaacacccatttagccgccctcgccgccctctcaagcttattgattgatcctgaattggtcgctaaacttaagaatgcacagtcacctgaagaagttcaacaactcttcggtgacgcccaagctgctaaggaagaaaaagaagccaaagatgctgctgccaaggccgaaaaagaagccgcagctgccagcaccaccactgacaaaaaacgtccctatttagttggggttaccgcctgtccaaacggaatcgcccatacttacatggccgaagcagccttgatcaaagctggtgaagcggccggtgttgacattaaaatcgaaacgaatggttctgaaggtgttaagcacttattgactgccgatgaaatcgctcgtgccgacggtgttgtgatcgccgctgacaaaaaggtcaagatggcccgttttgatggtaagcacctggttaaccgtcccgttactgacgggatcaacaaggccgatcaattagttcaagaagccttgagtggtaaagctcctgtctatcacgatgttgatggtggtgctgcggatgacgatgaaggcggcagcgctaatggtagcgtttggggtgaagtttacaaagacctcatgaacggaatttcccacatgttgccattcgttgtcggtggtgggatcttaatggccctctccttcattattgagcaattcgttggtagtaagagcttagcctttaccttcttcaaccaagctggtaacatggctttcgccttcatggtacctgttttagccggttacatcgccgaatcaattggtgatcgtcctgccttgatgcccgggttcgttggtgggttcatggccacggtttacactggcgcttacggtggtgtttacacagcctccattaccgccaatgctaagagtcccgctggtttcttaggtggtttagccgctggtttcttagccggttatattactgtttggatgaagaagtggaccaagaacatgccacaatccttagacgggatgaagccaatgctgatcttcccaattctgggcttattgattattgctgcgctaatgttcttcgttgttaacccaatcttctcagttatcaacgcttggattacccacttcctgaactcaatgggtactggtaatgccgttctcctcgggcttgtactcggtggtatgatgtcgatcgatatgggtggtcctttcaacaaggccgcttacgtcttcgcaactggtgcctttaccgcaactggacatgggaacttaatggccgctgttatggctggtgggatggttccaccattggcaactgcgattgcaactgccttctggccaaagaagtttacggatgatgaacgtaaagctggtatctctaactggttacttggtatttccttcattactgaaggtgccattccattcgccacggctgacccattgcacgttatcggttcaagtgtgattggtgctgccatcgccggtggtttaacgcaactttggggcgttgccgtccctgctcctcatggtggcctctgggtctcattactcgccacgaatatctggggctacatcggtgccacaattatcggtgccgttatcgctggggttatccttggtctctggaaaccagctaaagcttctaaataatgtgatatctaaaaagacgatcaatttgatcgtctttttttgttttcaaaattaacgaatcagccgtctaaccccgcaataaaacgggtataatgaaagtaatataatgattatgttaacgagaatcgagacgagtttgatgaaactacgaaaatctatctttggcatcagctgtgtactattcggcatgatgctgctttccggttgccaaaagcaaactaaaatgaccctgccccctgtcagtcacaagaccttaacagcgatggtgatcagtgatgaccatgtcattgcgcccagcctgcatgataatggtaaggctttcacgcagtacgcggctaacgatgccggtgcggatttaaaatacagcgcgacgattttccgcgcttttattgctaaggcgttggtcaccaagcctgacgttgtactcatcagtggcgatattactaacaacggtgaaaaagccagtcacgagtacgttgccaagcagcttcgccgactgactgctaagcacatccacgtctacgtcgtccccggtaatcacgacttgaacaaccccatcgcccgtcgcttcaaaggaaagcatcaatatagcaccgaggcgactagcccgacccagttcaagaagatctatcatcaggccggctacggccaagccagtgaaactgacccaagctcattgggatatttggtaaaacctagtaaacacacttggtttttaatgctaaactccgccatttataaaagtaattatcaacaaggtaattcaacggtcggtggtggcctgaccgatgggaccttacaatggcttactaaagtcggtaagcaagcaaaacaagcccatgcgactctcattcccgtcctacatcacaatacaatggaccacacggtgattcatcaggactatacaatcggttatgccgaagatgtccgtaaggcctttaccactgcgggtatcaagttatcgctcagcggccatattcatgctcaaaatatcaagtctaccaaagtcaagaaccagtcactgactgatattgccagtggcgccctgatactgggatctcactattacggtacgcttaagatcaaccagagtaacgggacggccacgtaccacgcgaccccgttaaacgtgagtgcttacatcaagcaccaccgtggtaataaagcgatgcgcgcctatcaaaagtacgatcatgacgtgttatatgcggctggctataacgcagcactgagtcagttatatgagaaccgtgacgaaacgcaactatcaagcgctaaagttaatcagctagcccgcggcatggcggccgccaatatcgcgctctttcggggcaccccagtcaaaaatagcgccgctattcaagcttggcaacaaatgccccacaatacaagtttgcgcggcttcgtgttagccaccaagaaactacacggcaacgtgacgtggtctgggtccgtacaataaccactttataaactaaagacgacagcgaattttcaggctgtcgtctttttgattagtcactacttatagctggtcagtcacaccggcaccaccctacttcgattcggctagattggttttcgcacacgtagcatttggttaacaatggtcattaaataatcacgcttgctaaatccgacgacggccgttatcaaaatcaatagataacggagtacaacactgtgatagcctcctaaaaatagaaagccaaccgccaaaaaagtgagcgtaatcagccccagtatcttgcgatcatatggaagcgtgccaagtttttcgcgacagattcgattcataaaccaataatgaacagccgcatacatcacatagcaaattaatgttgtatatcccgccacctcgtatcctaaaattggaatcaaccaataatttagcgccacattcaatactgcgccaataacactggcaatcatgattaaagatgttcgttcataatagaactcaaactttgcaaataaatcaaaagcaaaaataaaaaagacgctcattgcgattggtggaacgatccaggtcgccttagcatacgctcgtggtgcgaatatcgaaacgatttcgggcgcaaatgcaatcaatagcaggttgacaaccgcaattaaaactaaggcaccgtaagcgacacccgcaatatcggccacccgtcgatccttgattttttgatatatccacggactcagcgtttgcgacaatgcaacgttaaataaaatcatgatttgtgaaagtgagtacgccaaactataaatgcccgcacttttcgtatttaccatgttcgcaatcataatccggtcagcactactcagaacgatttgtgaaagataatgtggggccaacgggatgttgaacattaatgcgtgacgccaaaaatggcgcgagaaaaacgttttgccacgatacatttgcacaaaaaacaagcccgtatagcctaccagttccactaatgctagccctaaaaatcgagccgtcactttatcattcgcatacataaccagcaatacgcctactaacggtttggcgattgcaaccagcaaggtcaccatcaccaatgatttgtattgcaaggcaactcggcgctcaccagcccaaaaattaaaaactgacgaggtccataccattagaagcatcgccaacatctgcgtcgtcgttaaagaaaagacactattccaaaaatcacgaaagccaaggtaaactagtgtccatgctaataccaacacaaccgttaatccttgtaatgcagccgaatatcgacgtcgatcatggctgaatttgatgagaccttgagtataaacgccgtagcacagatttagtgagacgatgatcgtgacgatagtcagccaggagtacagcacattaaattgaccatactcggaagtagacattattctggtaaaaatgggcgttgcgattattgaaatgctcttttcaaaaaaagcacagactaagaaccaaagtgaggccttaacttgttttggcagatgccgatatttatttctaatactgactaacataaattcctttctcataggtctgaactgagcatcacatcccgtgcttactaataaaaaatcttataagcaccgtacacgttcaatcacttggttgttgtcgataccggcgctcatttaccgaccaaatcgttcttaaacataaatagttgatcacatagtaacaattatctggggatgtcaccattgcgcggactaacgcggtcagggcctgaccaagttttcgtttgcgcatactggccatcgctatcgtaaaatatttttgcccacgattaaacgtactttgagcacggacgtcatttattttgtctgttaacgccgacatttcgcggccgaaactgtctgctcccgtccgtttacgttccgcatacaattgttgaatatagcgcgataccagatacgttttccacgcgtcgctggtcatactattaccgcgtaaccgatagttcaacactcggcggttaattgacccgattttgaatccattagcaagcagccgcagccagagatcatagtcctcggccgttggtaataaacggtaaccaccgacttgttggacggccgttttccgcattaaaacggtgggatgaataattgtcgaaccatagggcaggattttttgaattagtggttcagcctctggaatggccgatttttcaccgacaacctcatcctgctcatcaagataagcaatatttccggaaattaaatccaaatcgcgcgtttttagcgcctctaattccacttcgagccgattagtgacagaaatatcatccgcatccatccgcgcaatcaactcattacttgctagctcaatcgccttattgagactagcggccaggccgaggttttctggattgcacactagtttgatcatttccacacggcaatcgtaatccattaacaagtcttttaaatcacttcgttctggattatccagtacgattacaaactccctcggcaaataggtttgcttcaaaatcgagtcaaccgcttgctggacttgctcaggtcgttcattatatacactcataattacgctgattgccattttttctcctcaatcttcaattcagttgaaagtaaataccccaagaatatcattgccgtcagtaccatgccgctgcgcgcaacctcacctttataatttgcgattagtagaactacgccaaaggctagaaagattttactatcacgaacaacctttccagactttttgtggcaagccgccaacgaggctataatcgtaccgtacagtagcaccatgtaaatgatgccgcccataaataagtcattaataaagccaatgtcggacgttccgaaccaaatattgctggcattgccaccatatacgcgaacaccataaccaaacacccaatctaaaagctgactcggaaacatcaagaacgagcccgtcagttgttcgtaattgccctgcttactaccttcaaagacgagtgcaaacgtatcttcaaagccactgacgatccaggtatacgtatcaggctggatggattgcagaaaagccaaacccagtatgataaaggtcacactcaacacgataatcagtgcaacctgaaacagccctcgaacactggacaccattcgtttgaccagcatcaaggcaaaaccaaaagccagcgtaatcaggccagttcggccgtttaatacgataataaagacacaaaatggcagaaaccaataatactttttgccaaggttcattcccatatatatcgcaactagtcccatcagactatggtagattggggtaaaaaatgtgtaatcactgctgattccatacaaacgttcaccataaataaactgattctgaataataccggtggctgtttttgctaaaatcgcagcgcgaatacccgaacttgccagcatgaccaaagcaaacaagcattgaacaaccaccatccatagcatccaggtcaagaccgtttcacttgtcacgttaaaatacttacgaagaacttctagccataacactaaggcaaggacattcaaaataatcacaacattttgaaacacccggggatcatttcctgccagcttcgctctgaacgcaaaataaataactgaaagcaccacgccaatcacaaaaattcgcagtcgatttatggtgaccgataaatcctttggtgacaataacaatatacaaccaccagtaatccccagtgtaacaatcaggggcacataactactgctccaaaagttgggttggtaaatcaggtaaaatccggcaatcaatagtcctagttttaagaatggcccgccaatttgacgatttactgcagtcatcgttccattactccttcataaacttgctggattcgttggataaatcgcttttgttcataatcactaaaatcgaccgctgctattttagccttggttgcctgataaaatgggtcatccgagaagagacgtgtcagtactgctaataattcatcatcactcgtataaacgatgccgtttaccctcgcagccgtttgagagaggccaccaatacggggggcaaacggaatcgcacccaacaaagccgcctcgaccatggtcaacccaaacgcgtctgatttggacgtcgacagcacaacttttgcatgccgcatgtatttgtaagggttacttttaaaccctaaccaccgtatttgtggggtggctgcaatctgtttagcgatgtgtgcgctcaagctaccatcgccgacaatcccaatctttagttcagggatagcgtctaataatttatgcgcaattctcacaaatcttgcgggatctttaacatcttccaaccgtcccacgaataacaggtcaaatgcaatggttgtgctggcagtagccagttggcatatccgtgaactgtcgattccattgggaataatcgccgtattggttaaatgtttgtggaagcgatacgattctttggcccaatctgaaacatataagactcgtgagctcttgttgccaatatattgaaacgccaaacttttccagttcacactagtctgccatatcggggcttgatggatatgggtgataattggcacatggtgaaaaagtaggttgaccaaaaaactcgctttgaaatcgtgtgcgtgaataatatctggctggagtgccagaatagctcgccgaaatttaagaagctgtttcggcgaaaaactttgatacgcgattccgacagcttgcaagctttcttgtatcgatcctgattgtgagcagtaggtgaaatcataggatccactcaaacccctactgatattaatgaccacctgctcagcaccacctaatttggcggaaaacaagacatgaacaatttttgtcatcgacaatcgtccctcctaggccaagcaacgcaaatagtacgcctgcgtttgttcaagcatctcatgctcagtatagtgacgttgatacatttgataggaattagtcttgacctcggtaatctttttcgattgatagagtgtcagaattttttcagcaatctggcgcgcatcattggtgaccaaaaagccattatgatcaatcaattcctgaatgcccccaacattcgacgcaataatcggcagaccttgggctaaggcttccactaaactgattgggagtgcttcataatcagaaatcagcaccccaacgtccgattgagaataatatttttgtacattatccaccaccccataaaagttcactttaccatccagattcaactggtgcgttagcgttttacaggcttcaatcgaagggccgtcacccagaaaatgacacacgattggtagattttccggcaagtatgtcaatgcttgaatcaggatatcctgccgttttggtgtatcaaagcgtgccgccattgatagtacaaagacctcggaactggtcgccttgtttgcgcccgttaatgctgtcacgccattatggataacacgagcaggatgagcactagtaatcacaccactttggacacccaaatcataatcaaactgcgagacacagatgtaagccgttgtcaggcgacttaatgctttttcaatagttttcatcaatagctgccgtttcttcccgacaccaggagtaaagccccagccatggaccgtaaaaatgactttcattggcaatctaatcgtggcgagcctcccaatcataccagccttcgaagaatgcaaatgaataatatctggctgccaattttttactaatttccttaacgtgtagattgctttcaaatcactcagcggtgcaatcggatgtaccaggctggcaactctgacaacttgcacgtcttgaaattctttcgcgacgcttgcactcaggcgtccttcaacgccgtatactaaggcaacggcattgccacgcatcacttgcgctttgatcaaactatatagatgcgcctgggccccaccccaagtcgcttgagtaatgatgtaaacaatcttcactaccgcgcaccatccccggaaataatcaccctaaccgttcccatcagcatcttgatatcaaaccaaatcgaaaagtgctcaatgtaatagttatcgtactgacacttggcacccggtgtaatatcatagccaccattgatctgcgcatagccggtaatgccaggaatgattcgtagccgtttcggaaaatcaggatagcgttcactgaattgttcggttagttctggccgttccgggcgaggtccgaccaaactcatatcgcccttcaaaacattccaaaattgtggtaactcatcgatccgagttttgcgcatccagcatccaaccggcgtcacccgaggatcatttttttgtgcccagatcgcacccgtctgcgcctcagcgtcctgatacattgatcgcagcttaatcacgtcaaaggtcgtccccatccaaccgactcgcgcctgcttgtagaaaacgggaccgtcagaagtcaacttgataagtatggcaaacacaattacgatgggaacgctgagcagtgtgcccaataagccgactgctagatcgaaacaccgctttagatccaccttccagccggtgaccggaacaccaattttgctaataaattcacagtgttgttcgtcagccacgattgattcattaatctcaacttcgtgcatgctcacattccccttcccagtacttggttaatcctcttctcaacggccactctgattcataatttaagcgtgccaacttgccaatacttgcaactgaatgatcaacttcaccaccccgctgctcggcccgtttgatttcaagttgttgaccagcaatctcttgatacatctgaataatgccatttaaactagtttctaagccattggcaatattgatcacttcatgttgcacttgatgttctgtaatcaaccataatgccttgataacatcacttacatatacaaaatcacgggtctgcgttccatcaccgaataatgtaaatggtcgctgtgttttcaaacaatccgtcaaaatcgacaaagcccccgaatacggtgagcttggattctgacgcggtccataaacgttgaagaaccgcacacaaacggtcggcaaatcgtacaactcaccgtatgccaatacaaaacgttcagtcgcatacttatcaatagcatacggtgacacgggtgcgacgcgcgaatcctcgcgttttggtaattcaggtagattgccataaaccgccgccgaagaagtgaatagaaattgcttaataggcaagcgaatttggcgaatatgttcgagcaagttaaataccgcggtatgattgacagcatgcgtttctgccggccgctcaatcgaatccgccacacttgcaatcgctgccagaaaataaatatagtctggccgttcgtctgctaacaattgttgcatgaatttatcgtcacagacatccgcgacgtatatcgtaatctgttcccaatgcttgatattgctgatggcccccattgacagatcgtctaccaccaccacctcaaagccagattcaactaaatgatcaaccaagtgcgagccaatgaaccccgcacctcccgttaccaatgccttcataactatttacccctctcaaaaaagccaaaattttcgtcgttgatttggtcgcaagacttcccctaacactactggatccccgttcagtagcagtcttgcattcactgcaaaagatgcaggattggtactatctaaccgtgctaatgcctgataacctgcccgcatcataaatcctcgtcgtgccatcaaatgcgcatctgaagcaatcacttggaccagcccgcattcaactaattccagcgctgtacttttaaccgctcgcccaaattgcccaacgagactccccgctgttagctgtgccaaacagccctgctgcactaaatcatagagccgctctggttgtgccataatctgagcatttcgctctggatgggcaatcaccggagtcgtcccttgctgtaagagcttaaaaattacttgcgccacgtaattaggtacctgctcgtgtggcaattctagtaacaaatagcgccgaccaacatcaattcctagcaagtgcggcagagctgtcgccaaatcatctcgcaaatggacctcctgaccggcaaaaacggtcagtggaatttgttgccgcttaagttcggcctggagctcggcaacggaccgctcaactaccaggccggtattctgataacgccgatctagatgatgtggcgttgccacgacgtaatgaatgccatcagccaccgcttgtcgcgccatttcgactgcctgagcaagctgctgggggccgtcatccaatcccggtaataagtgacagtgcaggtcaatatactcagttggtctcagtcccataatagccgtacccataaccgtgagttttaatgtccacgtcatttaaaatagtcccgagtaattgtgcgcgagcattcttcaaggcactcactgcctggcgcaccgcaactttttcgacaaagttttggcgaacgactaggacagtgccatccacttgaccagctaaaatccgagcgtcggtcacgggcagtatcggcggcgcatcaacaatcactaaatctaacttacgtgttgcgaccgttaaaaactcggtcattctatcgctggctaataactcagctggattgggtggtttaggtccactcggcatgacaaacaaatgatcaagtacgggataaatggcttcgttcacgtccgtcagttgcccgcttaaccatgaactcactccccgttggttactgattgcaaacgtctgatgaatcgtcggccgccgcaaatcagcatcgacaagtaagacttgcaggcctttcttggcgtattccacggctaagttgctgccgaccgttgattttccctcgccctgaatcgctgacgtgatcattagtgttttcaacggtttaccgaccatcgcatagttaagatttgttcggatcgttttgacttgctcagttacgactgacatcggtgccgtcaaagttgttaactgtatgccggtatgcatattcgctactcttcgcctcaatttcataaccgttcccccctatgttaaactcgtttgactgccgctttaacaactgacgtcaccggctgtggtttaatcgccggttggtcgtgagtcgctgtgaccggctgctgatgattaatgattcctagacttgtcagcattaattcatctgctaggtattcgagtgtctgcacccgccgattggacaagattcggacacttgcatacaccaatcccaaaatcagcccccccacgaaaccaattaggatattgatgatttttttaggcgctaccggctgatccggcgtctctgcgggtgcaacgatcgttacattattgaccctaataatatgctggacctgatctttaaacgttgcagcaatttggttcgcaatcattgcactagctttcgcatttttatcacgaacaacgattgaaaacacctgcgaattggccgtactggtcacgctgaccgtttgcttaagcgactcaagtgagcgtcgaatgtcagtttctgccattaaagtctgccgtgccggcttcaacacgactggttttgtaattaattccttataagtcgtaatcatctgcacatcggcttgctggcccgtcaaatccgcgcccgcactactgtgtttgcggttaactaatatttgaacattggcttgatattcgggctgaatgacccacaaagtcaccaccgttgcaatcgtcccgcccaaaatcattaaactcaataatatcttccaatactgacgaatgagtttaacaataaaatcaaaggttattacttgctccattccacacgctccaatatttcttgactgacttttattaaacgattgacattattgtagaaaaccagttgcaaacgacgcaatagttttcacgaattttcatgaaactcatataaatacaagcgaatattcgacaatctctaaatttaaattgacattatagacaataatgttatatttattgatagttactaatcaaaataatataaatcgtataattatttgactttattttagctcgtatttacccacaattatttcgattaaatcatcggttactccagcaaccaatgtgcttttcaactaatcacaaaatcgacatttttacaaatcaatgatgctttcaagcatcaaaaaagaccacctagttcgtgaaaactagatggtcttcttaacattaattacattagttagccagatgacaactatgtggcgcccttttgataatgcttcggtgttacaccaccaccggctaatgaaaatttgacagtttgtgcaacgtttttagcaattcccagggactgaatctcttccagtgaggcaccagcaattttactcatcgatccaaatttacgtaataatttattacgcgtcttcggcccaacaccaggaatctcatccaatcgcgaactcaatgaatgtttggtatgcacttgtcggtggaacgtaataacaaagcggtgcacttcatcttgaatacgttgtaacaaatagaatccttgactcttcggatctagatgtagatgctgatccccggccgaagcgagtaaatccgccgtcttatggtggtcatttttgaccatcgccgcgactggcgttgcaatccctaattcgttctctaagacgtccttagcggcttccagctggatctcgccaccatccatcaaaattagatcaggcaatgctgcatgctccttcagtagccgtgtatagcgccgccgaatcacttcacgggtcgatgcagcttcatcagcatgatcgaccgtccgcaacttatatttccgatacaattttttattcggttgcccgtccgtgaagacgaccatggcagaaaccaagtcggccccttgaatatgagagtggtcaaaagcctcaattttatgaccagcaggaatgcctaaagcatccgtgatttcttgcatcgcccccgtcgtcttgcgctcatccaattccaacaaccggaacttctcttctaagacgattcgagcatttttttgtgccatgtccagcaaatcctttttctggccgcgttgaggggtccttaccggaattccgagaatgtcactcaggacctgcttatcaagaccgttggggactaaaacttcgcgtggtagaacgttatttttgcgattataaaattgcaagataaagctcgtcatttcttcaggtgcagttgacactactgggaacaagcgtttctcgcgcttcatcaaccgcgcttgccgaataaagaagacctgaatcgaaagccagcctttatcaagatagaaattaaacaggtcgcggggcgtattatcgtttgaaataattttctgcttttcaaccgtcatttcaatataattcagttgatcacgtaattcagcggctcgttcaaattctaggtcagcggccgcttgatccattcgtttagttaactgcttcttgaccgtttcaacgtgaccattcaaaaaggatttaatccgcttgatctgagcgtcatattctgccaccggcaccgttttaaagcaagctcccaagcattggcccatatgataatagaggcacggccgcttctggaaaccatggcaacgccgcaacggatagaccttctgaataaaattgaccgtttcctgagccgcgtaaacgttgggatatggcccaaagtagtagccaccgtctttacgaacatcactgacgatcaggatctggggatctcgttcattggtaatcttaatgtatggataaccggttcccttttttaatttaatattaaagtacggttgatgtttttgaattaacgtaatttctagcaggaaggcttccttatccgttgaggtcacaataaactcaaagtccgcaatctctgatactaaccgcgcggtcttaccagtatggctgcttttgaaatatgaacgcacccgatttttcaagttcttggccttacccacataaatgatctgactgtttaagttcttcatcagataacatcctggtaagtccggtaacaaggataacttatgttcaatatgcgcggatgccataacacaccttcccttcatttagattagcattattagtataccgcctgctagcatggggctcaaccaaacagcccggaaatatgatttttattatgaccgactattcatcactgtcgctactgatcacagtgtagcaaaaaaccggtaatcagcaactgagctgattaccggttatgtgttgtttacatcaaaattttagaaagaaaatcttgggcccgctctgtttgcgggttcgcaaagaattcctcaggcgtattattctcctgaatatagccatcagccatgaaccagattcgatccgctactgacttagcaaaacccatttcgtgagtgaccacaaccatggtcatcccatccttagcaagttcttgcatcacgtttaacacttccccaaccatttccgggtccaaggcagacgttggttcgtcaaacagcatcacttcagggttcatcgccaacgcacgagcaatcgccacccgttgagcctgaccacctgaaagactacttggaaaggcatccgcatgatcgtccaacccaacgcgttgcaataattcgtgcgcttgcttagtcgccgcggcatcatcgacatgcttgaccttcatcggcgccaatttaatgttttccaatacagtcatgttgggaaatagattaaacccttggaaaaccattcccattttttcacgtagcgcgttaacactcttcgtatccaaagttgtgagatcttgaccttcgaaagcgacttgaccacttgtgggcgtctcgagtaagtttaaacaacgtaagaaggtactcttcccaccaccagaaggaccaatcaccacgatcacctgaccgggttcaactttttctgtaatatcctttaaaacgtcattttcaccgaagctcttcgcaaggtctttaacttcaattactggtttagtcatgttgcattctcctttcgaagtagttcaagatccgtgaagcggtaaaggttaagatgaagtatagcaccataataacaacgatcggtgcaaccccccggtacgtatctgaacgaacaatgttactttgataaattaattcagtgaccccaataatcgaaacgatggaactatccttgatcaacgtaataaattcgttcccaagtgatggccaaatgttcttcaatgcttgtggcaagaccacgtaacgcatcgtttcaccgttggacattcctaaactccgagcagcttccgtctgcccaacatcgacggaattaatcccgccacgaatatattcagcaacgtacgcaccagagttcaaggaaatcgcaataatcccagaagtcagtgctggtaaattgacgaataacccaagtccgaagtacacaaacatcacttggaccatcattggcgtcccacgaataaattcaacatacgcagttgctaaccaccgaatggcagtcttaagtggatttcctttagccatccgtgctaatgccaataaaataccgatgataaaaccgaagaaaacggagcaaaccgtaatgattaacgtatattcgatcccggttgcaaaagccttccagtaatgtcccattgacgtattaacggtattggtcttcaaatacttgccggctgccggtaagtattgctttttaacgaggttctgtttcttaatccgatcaacggtcttattgactttgttaacaagactagttgaacctttccgaaatgcgatcgccgaactcgttgcactagagctcatgttgaagtcactaggaatagcaaccaaactcttattgtttgcaacataggcttctgcagaaggcttttccatagcaaccccatcgactttgtgactctgaagtgccaaaatcagatcagattgtgaagtcatccctttagccttggcagtcgtttggtttttgacggcattatattgagtcgttccagtttgggcacccaacgtgccattcttgaatgaattcttattcttgtacttgcccttatcagtcttattgatgacaatatcgtagccaccttgataataaacgtgggtaaaatcaacatttttccgccgtgaaggggttgggttcatcccagagataatcatatcaaccttgccagtttggagtgccactagcaatgagtcaaatgacatggatttgatcttcagcttcacgcccagatccttagcaacttgtttcccaatctgaacatccatcccaacgatcttactcttaccgttgaccgttgcttgaaactcatacggtggataatcaggcgacgtccccattactaagacgccctttttctgaatttgttctaatgaattatcggccgcttgcgcatgttgcgtctgtccgagtgggacgacggtcatgatcagggccacaataatggctaaaaaccacccaaatctttttttcataggtattctcctcgttttgtaatttacaagaataaagtataaccgcatatgattatttatgcaagtatttttgagaatttctttattttatgcataaataagtcgtttatacacgttttgacccattgattatgcataaaagacgaataactgacaaattgtcggaaatttgctatgataggcgttaatcgaaaggaatgattttatgagtttaaaagtacagcgtcaagataaccttgataagctattcgacaagtttgccattggtcctgacgataaggataaactcaccactaaagcggttcaggatactattgacgaacatgctaaacgcaaagaaaataaggcagctgataaaaaggacgcccataaatagcagtcaaaaaaaacgcaatggcagttagccatcgcgtttttatttgaataactatttagcaaattttagtcccgattgtttgcatcttttcgcgccgctctgcttccgtttctggtgaaacatcgcgccaatcaacaacagccaaagcaccgtcgagcatcccgctatcatccttgagcgctaaagcattatgccagcgagaaatgttgaggccgttccccaagtaggcttcatcagccggtgcaacgtgcatcacataaccagcattattttctaatggcgtggtatagtcgggatcagcggctttaagaataactaactgaaacttattaccaatggcacagctaccgcctaaactcgaatatttgttagaaccatcgtcagttgttaaaattacttgactccctgccggaatcttatctgcaaggtaggcttgagcatcgtctttgatattaatcttcatagttaagcatcctttccgtttcaaaaacatttaagttgtgcacaactcttttacagtctttaatttacgctatttcagctgcaaatgcaattaatttacctagaaaagtgaaaataaacagccgaactcaataatgacacaatttttgcaaatgatatgtggtcgttcgtcgcaataaaaaagagttgggctgccagccttacctgctgacagcccaactcttcaggttagaccactcttcactgactatttaactggtttaccattcgggtacttatcgttgagtttaacaatattttgttgcgcaacttcttcgaacggaatatccgcccattcagcaacttgtgataagtaccataacacatcgcccatctgtttcgtcagctgatctttattcaaacgttcaccatgaaacgtatactttttgactaagtcaacgacttgaccagtctctgaagctaatcccagcgataagttcgtcagcacctgctcattaccatataatgtccgatttgctaacgactgatactcattaaattccaagttagttgcctcccacagtgtgcgcttcgatccattgccaaacagcatccttgccttctttggtcttagctgaaaaggcgataaaatcgtcttcagcttggaagttaagcgtctttttaattaaactttcctgtttgttccacttaccacgcggaattttatcactcttagttgccacgaccagtaatggcatctcatagtaacgcatccactcgtacattgcgacatcgtctttggttggcgcatgacgtgcatcgactagaataacgacacctcgcagtgtctctcggcttgttagatacgtctcaatcatttgtccccacttctcacgttccttcttagataccttagcataaccgtatcccggaacatcgacgaagtataattgatcttcaactttataaaagttcagtgtttgggtcttcccaggttgactagacgtccgcgcatagctattgcggttaatcaacacattaatcagggatgattttccgacgttagagcgccccgctaacccaatttctggaaacccagtagtcgggtactggctcggcgctaccgcgctcatgacaagttcaacgttatgcacttccatcgaattaactccttctgcaatcgtattgcattcattttaccataatttttgcagcgggttgtcatccgcgctcaaattcgatttaaacagcactcaggaccgcgaatgaaaactcatcgcggtcctgagtaaatgtctattgatcttctgaacgaaacgttaggaagctttttgatcagctaaaaccagttctggttcagcgtgatcagcaaccgtctcgcgagtaataatcacctttttaacatcttcacgacttggaatatcatacataatgtcccgcatcgtgtcttcaataatcgagcgtagaccccgagcaccagtattacgtgctaaggcttcttgcgcgatggcacgtaaagcgtcatcgttaaagtctaattctgcaccgtctagagcaattaggcgttgatattgcttgacaagcgcattctttggttccgttaagatccggaccaaatcatcttccgttaaacgttctagcgcagtcaagattggaaggcgcccaataaattcaggaattaaaccgaattgtaataggtcttctggcacaacttgttgcatgagactcttggaatcgtctagaacggcattcttaccatcggtgtccgtaccgaaaccaatcgttttatcgcctaggcgacgtttgacgatgtcttcgattccatcaaaggccccaccaacgatgaataaaatgttggtcgtgtcaatttgaataaactcttgttggggatgcttacgcccgccctgcggtggcacattggcaatcgtaccttccaaaatcttcaagagggcttgttgaaccccttcaccggaaacatcccgtgtaattgagacattttcactcttcttggcgatcttatcaatttcatcaatataaatgatccctttttcggcacgttcaacgtcgtaatccgcattttgcagtaatttcagcaaaatattttcaacgtcttcaccaacatagccggcttcggttaacgtcgtagcatccgcaatagcaaatggcacatccaaaattcgcgctaaactctgagctaagaaagtcttaccagaaccagttggtcccactaagctaatattactcttttgtaattcaggaccatcttcggtctcttcatcattatcagccatggccttaacccgcttgtagtggttataaaccgcaactgatagggtccgcttagcttcattttggccgatcacgtattggtctaactcgtctacaatttcctttggcgttgggatatctgttaattcatgggtttgttcttcgctaaactcttcatcgataatttctttacataaatcgatacattcattacagatataaacgccggggccagccacgatctttttaacttgatcttgtgatttaccacaaaatgagcagttcacagggccgtttgtctcggtattttcaaacattcattctcacctcatcgatgtatttacatggattaatcataacagaaaaactgagctaaaaccagcttaggcactgtcttctacgtccactactataacatggacgaacctaaacccgaaattatctgttcaatcatccggctaaacactttgaaaaccgaatgattctcgcagtaaatcgcaggcgtcagccaaatagctattaaattaatattatgattagctgacgctatgtaaaagggtctcggaagaattactcttccaagaccctcgacttgtatctaattgaattaattagttcttgtcgctgtcgtcttttttgtcttctgctttggcattttgcttagcagaatccgcaatcaagtcaacggcttggcggatcgcaatgtcatgtgacaacatgtcatccgttaaagcaccacgaacagcactttcttccatgttgtattgactagctaaatccttaacttcggccgcaatttcatcctgagatggcttgatgttttcagcttcaacaaccgcttctaagaccaagttagtcttaacccggcgttcagcatcagcagcaaattgcttgtgcaagtcgtcttcagtagtaccagtcaacttgtagtaagtctttggatcgataccttgttgttgcatattagccaagtattgatccatttgacgatgaatatcgtcttctttcatggcatcaggaattgcttgaatttcagcattgtcaaccgcttggtttaaagcttcgtcttcaatggcatcatgcgcagcggattccttttgttccttaagttcgtccttgatcttagcttttaattcttcaagtgtgtcaacatcttcgtcaacatccttggcaaattcgtcatctaattcagggagttccttagtcttgacttcatgaactgtcactttgaaagtggcttctttgtcttgtaagtcttcagcttggtaatccttagggaacgttaccttaacttcagtttcgtcgccagctttgacaccaactaattggtcttcaaaaccagggatgaatgagttagaacctaattcaagtgagtagttttctgattcgccaccttcaaatggttcgccatcaacgaatcctttgaaatcaataaccaccgtatcgcccttagcggctggttggtcttctttcagaactaattcagcttgtttttcacgccgtgattctaattcggcatcaacatccttagcataaacgcgagtattttgacgcgttacactaagttccttgtattgaccaagcttaacttctggtttaaccgttacaacggcctttaatacccaaggcttacctttttccatgctatcaacatcgatttgaggttgatcaactggttcgatttcagtttccttgattgcttcttcatatgcctctgggagcacgatgtttaaagcatcttgataaagtgcttcttcaccatacatttgattgaagatttgacgtggaaccttacccttacggaaaccaggaacatttaagttctttttagtccgttggaaggccttgtcgataccttcactaattttatcagcaccaatttcgaatgttaattcgccttggttgccttctttcttttcccactttgcagccattgtattccctccgaaacattataatttctacaattctagtcaattgcatacttgttaagtttaacctatcgacaccgtaaagtaaaccaaattggctaaaaaagcgcgtaagctcgcgatttattgttcgtttttcttaaaaaaagcgacttggaagaagacttccaagtcgcttagatcaatcaatgaaaatcagttagagattagtcatcaatttctgaaacaacaccggcaccgacagtatgaccaccttcacgaaccgtgaacttggtacccttttcgatggcagctggttgaatcaattcaacagtgaacgttacgttgtcaccaggcataaccatttcaacgccgtctggcaattcaataacaccagtgatatcagtggtgtggaagtagaattgtggacgatagtttgagaagaatggcgtatgacggccaccttcttctttgctcaagatataaacttcacccttgaacttcttgtgggtttggatcgaacctggcttagccaaaacttggccacgaacaacttgttcacggttaacaccacgtaataacgcaccaacgttatccccggcttcacctaagtcaagtgtcttacggaacatttcaagacccgtaacagttgacttaagaacatcttcgtgtaaaccaacgatttcaacttcgtcgccgaccttaacagtcccacgatcgatacgaccagaagcaacagtcccacgaccagtgattgagaagacgtcttcaacaggcatcaagaaaggcttttcagtatcacgaactggagttgggatgtattcatcaacaacatccattaagtgcatgataaccttttcttgttctgggtcgccttcaagtgctttaagcgctgaaccacggataacaggaatatcgtcaccagggaaatcgtattctgaaagtaattcacgtacttccatttcaaccaagtcaactaattcgtcatcgtcaacaagatcagtcttgtttaagaagacaacgatatagtcaacaccaacttggcgagccaagaggatgtgttcacgcgtttgtggcataggaccatcagttgcggcaacaactaagatcgcaccgtccatttgagcggcaccagtaatcatgttcttaacgtagtcagcatgtcctggggcatcgatatgagcgtagtgacgcttttcagtttcgtattcaacgtgggcagtgttgatagtaataccacgttcacgttcttccggagcagcatcgatagaagcaaagtcttgttctttagccaagcccttagatgctaataccttagtgattgcagcggtcaaagtagtcttcccatggtcaacgtggccaatagtaccaatgtttacatggggttttgttctttcataatgttcttttgccattaatgaaacctcctgtgattttcgcaagaataacgtcgaggccaaaatggtctcaacaattctttagttagtattatactacatcctagtgaaaaggccaaatcgcgcacccatcactgagaatccttaaatattatatatagcctaatctgatttgtaaacagatattattcaaaaaattgaatttttgttagtaaattcttattacacacgcttatgattgtaaatcaaggctaaattgctgaattttttgctgaattttcatcattttttcagtttggtcatcagacggcgttatcgtctgcccagtttgcaaactaatcaaaagatcgatccaagccgtggaatctgtaataacctgtgcagcgcatggatataaatacattaattgcaattgtaaaagttctcgtaagctttcatataaaaagacatcttgattaccaagtcgcactttcaaagcatggtaaacggccttgctcgtctcgtcctgaccgagtgcgactaactttgctggacacagtgtcaacatcttctcatccagtagccactgcatcttgaccgtctctgatacttgcaattggtacagtgtatataacacttctactcgtgttaagggatgcaaaaacggatctactaatagaaacttggctgccgtcagatagcgctcatatggcaggtgacgggctgcttgcaaacctgccacctgtttctggacgggctggtcagataaatgataaaaatgacgcattgttgtggtcaatgtcgatcctagcgttcgctcagccgtactctccgccgcttttaaagttgtgtttgcagccgtagtccacgcactcgttgggcgtgccttgatcataatgtgggcagaaatgaagtcatgattagcaaccaatgcattcagatacagatctgcggccgcatcggttgctaaatactgcgcttcaaactcactggcataattagctgctgccacatattgttgatcagccaccaacgcttggaccaattcgtaattaactggtgccgtttgctgtgcctgatacacttgctcccacaaactagccgccttggaccaatcctgagctcgactggcttgttcggcggccaattgtgtttcagctattgtcattgaaccttcctcctcttcattgtaaccaaaaaagtcggaagtagcttccgacttttttaatactaagctttagattcagtctcgactggtttggctggtttagccttctttgtacgccgatgatgctgattaacttccataataaccggtaaaataactgggtgccgcttggtctggtcccataaataatggttcaacttctcacggacagcctgttttaaatggccccaatcaaactctttattatcaagattttcttgcaccgtcgttttgactaactcagcgctctcttgcatcaagtctttactagtcttgacgtagacgaagccccgtgaagtaatcttaggagtggcaataatcttcttctttttgcgatcaatcgtgaccactgccacgaaaataccgtcttcagacaaaatcttgcggtcacgtaacacaatgtttccaatgtcaccgaccccgattccatcgatcatcgtatcgccgacttcgattgaaccggccaagtgcatggtatcaccgtcataacgtaactggtcacccttggctgcgatcaggacatggtcgtccggaattccaacttcacgtgcaaagtccgcatgagcatccaacagacgatactccccttgaatcggaatgaaatattggggcttcatcatgttgatcatcatttgcaagtcacgtttagcggcatggccggaggaattcatttcatcagcaatcgccttaacgtccgcatcagcacgataaatcatatcacgggtcttggcaaccacggtttccatcgaatgtgacggtgtggtagtaataaacaccagatcacccttttcgatattgaccttgctctcctgcttattagccatccgttgtaaggccttaataggttcgcccattcggcccgtttgtaaaatcacgatttgttcaggtttaagtttatcaatggctttaagtggcacgacaacgtcttcaggcatgtgtaacttgcctaaatcgattgcggtcttcacgatactctcaacgtcaccaggcattaaagcgactttccgattagactttgcagcggcatctaaaacttgctgaatacgcaagatattggatgcaactgaagcgacaatgatccgtcctggatgatatttaaacgtttctaaaacataggccgcaatttcacgttcactgaccggctgttcataattttctgcattagctgaatcactaagtaacgccaagacgccttttgatccaatctccgccaaccgcgcaaaatcagtctgatagtcgcctgcggccgtcggatcaaacttaaagtcaccggtataaacgacctcaccggcactggtttgcaacacgattcccattgaatctggaatcgaatgggtcgtgcggaaaaacgaaaccgtgaccgtgccaaaatcaatttctgtcttctcattaatgatgtggaagtcattaaagtttttagctttagggtccttttgcaattgaatttttgccaactcaatggttagctctgaaccaaacacgggaacgttgaactcattcaaaaagtacggtaacgcaccaatggcatcagcgtggccgtgggtcaaaaagacaccgacgattcgatcagcattttctcgcaaataactgaagtccggaatcacgatatcaattcctaataactcattttccgggtactttaacccacaatctaaaatataaatatcaccatcgacttcgacagcatacatgtttttgccgttctcacggaccccaccaaatggggtaatttgaatttcactactcaattatttcaccttgattcttctaaatgtttaatgttttaaaaagctgagccgtttgttcagtactcaatggtaagattggtaaccgtggttcacccaccggctgacccaaatgatttaaggccgctttaactggcgatggcgatggtgcactaaacaaggcactcatcttgggtgttaagtcccgttgatacttagcggccgtggcaatctcaccctggtcgatggcactaaacatcgccgtcatttcgtcaccatagatatgacttgccactgagataaccccagcaccaccaatctccttggcagccaaactctgagaatcttcaccagtataaacaagaaaatcagccggtgcattttcgacaatcgcgccaaactcttccatcgtcgcacactgcttaatcccaataatattgggattttgtgctaatgttaagatcgtggccacggtcatcttcacaataacccggcccggaatattataaataataactggtaagccaccttgatcagcaaccgctgtaaagtgggcaatcataccagcttgatcaggcttgttgtagtagggaaccaccactaaagctgcatcaatccccttaatctgactaaccttcttagtaaatgcgatggtagcagcggtactgtttgagccggtcccggccacgattggtacccgaccatcgacaatctcagctgctttctttagtaaggttaatttttcatcttcggttagcgttggtgcttcaccagttgtcccacccaccagaataccttgggtgccgtgtgccaataaatgttcaatcaaacttgctaaccgcttttcgtccaattgttggtgatcatcgaaaggggtcaccattgcggtcatcaaatcaacgtttgcaaagttcatgatctaaaaactcctctattaaaatttacaagtaccagcgtacctgttccgattaagtaactctccccagtttaccacattttaaagtaaagcaatagttagaccattcaatgcaatctaatgtggtcgttgctgactaaaatacgcgacccacagcatcaatgccatcagctgtaatccagccgtaacaataaagattgactgatacccccaccaattggcaacaatcacggctaacccggggccgaccacgttaccacaagcttgcgcggactgatttaaactaaacacacgcccaaacgctgcgtgtgggacatgctcgactgtcatcacttgaagcgcgggcaatagtgccgcatccgcaattcccagtattagccgtagcccgaccagccacgcgacctgatgtaccaaactagtcaacaataagtcaacaatcgctaaaatcaaaaaagtaactaagcaacggccagcgcccagccgatccagaatgcgcccaacacgaccagccattagaatcgtggcaagtcccggcgcagccgccacaatccccgtcatcaagataatcgtctgcgccgttgcttggggcgctaactgtccgaccagcaagcttaacagtggtgttatcgcattggtcgtcgcctgaacaactagtaacgatgtcagcaaggcacaaataaagcgaccacccaattgatgtaagattggtcgcaatggtggtaacgtggcgcgactaactgccgtcaccttctcttgaacaccccaccaggtcatgacaaagacaagcgccatcaaactactggtagccacgaacgccccccgatagccaacggtattagccagcaagcttcccaaaagtggccccatcaatgtgccactaatgctaccagtgaccagtttacttaaccactggccacgttgttccgcaggtacggtaatcgaaatcagtgcgttagcattattgatgtaacctgaaaacgctccctgtgcggctcgtaaaatcaagaggacgatcacgttaggtgctagtcccacaccgagaatcgttaaggtcatcatgccagatgcgcgtagacacatcagcttacgccccttttgatccgccaatcggccccacaatggtgcgactaaagctttgcaggcgtatgtcacggcaaacgccgctgcccctagaaaattcaactgggtcgttgaataatcgcctaatgtctgaatatacagcacaataaacggtaacgtcattgcgttacctaaatcagtgattaaactgccaaaccataagacccgaaagttacgagtcaacgttgccattgcttccatgaaatcccctcattcacttttgaataaacataagtatagcgaacggttgtttgggtttaataaagtttatgtatcgtttctgtaattttttacacaaaaaaagaaccacccgcaggcagttctcgtaatctcaatattaacgacgaagaccaagactttggattaagtcacggtaacggttaacgtcttctttacgaaggtaagctaacaagttacgacggtgaccaattttcttcatcaacccacgttgtgaatgaaaatccttcttgtgaactcgtaaatgttcgtttaattcgttgatgtcttccgttaaaactgcaacttggacttcaacagaaccagtatcgccttcgtgacgagcatacttgttaataagctccgtcttcttttcgcgtgaaattgccatgtgtttcaaccacctttccaataattgccctaaactgagtaaatcgttggtggtgcacgaaaaactaagtaaagggttgctgaacacttgatatagtctagcaaactaaggagtaaaaagcaagtttcaatacatatcaagataaattactttacacataacggttgcattcaagccggggcttatgtataatagcatttgttgaaaaaatgatggaggtgaatctgatgccaattatcaaatccgctattgaacgcgtgaaaacaaacaataaagcaaacgtccgtaacaccgcccaaatgagtgcgatgcggactgctgttaaaaaatttgaagctgctaaaactgctggtgccgacaacgtcgacgatttatacttagcagcaactagcgccgttgacaaggctgcttctaaaggtcttatcaagcgcaacaaagctgcccgtgacaagtcacggatggctgcacgttacgctaaataagctaattttacgcccgagcattgcgacggcgtttttttatcgcctttaatgactcaaaagatggtcgaccgaattctgagaattccggtcgaccatctttttttgggctccatatctaagcactattacttttgccttcgtgaatagtcgttctcgcttgtccaacaagccaatgcctaacgggacagccgcgttccgaccactgcctgtcgctcattaacaaattgaaccataaataactcaaagagcaactccgggtcgcgttgtgtcgttttcatttgtacttctgtttggagcagtcctaagtacgccgcccgtaacgcagcttgatcaaaatggcggaccgtttgcatggctagtttgacccgatatgggtgcactttaagcgtgctagctaggctgccctgactatagcctgcacgcgccataattttgacctgtagcaacaatcggaattgtcctaataagattgcattgatctttagtggggcttcctgagctgccaccagttcatggtaaagttcgaccgctgactgcgtctgataacgaagtacatcgttgaccaaatcaaaaacattttgcgtcagtgatttagtcaccaaagcctgaactgccgctaaatcaattcgttgggattgggctgcgtaaatcatcaacttcggtaattgtcccataatcagtcccaactgcccgtcagttcgattaaccagttcctgtagtgcgtccgcatcaatgcgaatctgtttctcatctaacgccgcttgcacatagcgttgcgtttcagcctccgagacttggttgacttcaaccgtcgtcgcctgtttttttaacgttttaacgagctttttacgcgcatctaatttctcatagggtgccataaacaccagaatcgtacttggttccggttgttcaaaatagtgctgtagtgaggccagatcatggtcaaccttggtcttcttattttcacccgtcaaaaagtacgggtgattaataaagactaatcgccgttcaccaaaaaacggtgccgacattgcatcatctaaagccacagctactggcgtcgtttccatatcataactgccgacgttcatcgtttgttcttcactgggaatttgctgcgtaaaagcctgtttgagctgatcggccaaatagtcgaccgttcccaagataacatagatcgatgccaagtcaccgttgcgaatcgattttaacgcctgttgtgcgttgatggcgatcaccttcctttaaaaatgtttgccaacgtccctggcgatgattaacgaaacgataggttatcatcccctgcaaagccgttgaataagtgacaatatgctgttcagctagagttattagtgtttcttgattcggatgcccatagcgattgtgccgacccaccgataaaataccgtggtgcacacctaattggcgcaaagctaacggatccgaggctgttttactgccatgatgccctagctttaaaacgtccacgcgtaattgtggatatcgggcaacgattgcacgctcccccgctcggtcaagatcacccgtaaacatgaaacgttgctgaccaaaaacccccgttagcaccaacgaatcttcattttcagcccgtcccggtttaaacggatgcaccgcaaccaatccatctgcaaacgtatggccggccaatgcttcaaccactttaggccgctttctggcaggcactagcagcttttgaaacttggccaggcgcgccattccggcaggtaccaccacttgattgaccggcatcaagcgtaatagttcacccaaatcaccaatatggtcaacatccttgtgtgataaataaactgtatccaagtgagtgatccctagccggtgcaaataattgaccgtaatcgtttccgcacgcgatcgcggttgtacctgctctgcctgccaacgtggccgggaaaagtgtagttgccccccagtatcgatcaaactcacttggcggttaaatggttggcgaatcaagatcgaatcgccctgaccgacatcgataaattgaacggcaccgtgaagtggaaaacgtagactaagactaaaacaagcatatgccagtaacagtccccagtaataccgacgccgcggtgtccgtaacaaccacaaactcaatagactgagcgtccatgcccacagtgtactcggttgaccgataatgagtaggcctggccaatggctgacccactcaagccaattctgaaaattaaccaacacccattcacacgcgctggtgacattggcagaaccaaagccaatgctcgcccccacgaccgtcaccggtaataatacccaactaaaaataggcgcaaccaccaaattgactgctaaggaccacagatgccactgcgccgtagccacaagcaaaaccggtaaactgataacctgaatccaaattgctaatcgccacggcggcaaaccaggcattaagatcagtagcaaggctagtccataactgagctgaccacctaattggctcaataccaaaggattatgggcaatccccattatcagggcaaggctccaaccacccaacgccccacttgactgatgtgttagcaactgccaaataattggtaaagccgcggttacaactgcccgccgcaagctatcggcaccgccgcccaagacaaggtatgctggcaagagccctaataaccaaatatcgattgcttgctgacttagatgcagtcgtaacaagacccattgcaagaatttaactaataaaataacatgcatacccgacaaactgaacaaatgcaatagtcccagctgttgaacggcccccattgtcgtctgaaaatctgtggggcgtatcccaaccagtagactcgtcgcataacgactaagcgttggtggcaatctttgacaggctagaaagaattgctgacgccattggtgtaatcgatcaagtagcaccagccaaccacgccgcggcgcaatttctattcgtcgaaccgctgtgaccgtcacttggcgggcgatgccttgactgcgataatacctaggcgcattaaactgccccgggttggtaggaggtgcgatggcggcgacttccccctgaacgtgccagatcgtccggtgagtaaaatggggcaaatactgtttttcagtggcacttttcagctgtcctctaacaagtactttgcccattggactagtggcaatcagctgatactgatcaccgcgcaccgtaatcgcatcgagttggacagccaaatggcttgtgaccacctgactgggccgctgaacaatggaggcgaaacggtggttttgccagttcagccagattgccaaagataaaacacagctaatcgtcaccatcaaacactgtcgatctcgtaatcggatgactcgcaataaccaaattaataataatccggctgccagccattgttggtcaactaaccaactactaagtaagccgcacgcaacggcggcaaaaaatagtgcgcgcaattagtcacgatctaacaagatttgatcaagattcagcttatccaaatctgattggtcgaactgaacttgttgtaaagccacgtgttttcgttcaattaaggacatggcatacgcatcgttatgataattacgtaaataatgaattttttgaattccagcttgtaataacattttcgtgcattgtaaacatggaaagtcagtgacatagatttcagcaccatccgtagctgcaccgaattttgcacactgcaaaatcgcattcatttccgcgtgaatagtgcgaacacagtgcccatcaacaaggtaacacccctcatcgatacaatgaacatcgccggatactgaaccattgtaaccacccgcaataatgcgtttgtcgcgaacaatcgtggcaccaaccgaaagccgctcacacgtgcttcgactcgccaataagaccgcctgcatcataaaatactgatcccatggaattcgttgatctttcatcattttatgcctcactttcaatgacagtagtataccaaaatgtgcgctttgaaactagacggtgagctggtctttgtatttggccacagtcttttctccaaagccactgacgtttttcaaatcatcaattgttttaaaattaccatgttgctggcgataatcaatgattttttcagctttcttctgcccgattccgctcaacgtttgcaacgcggccacatcagccgtgttgagattgaccttatccgttgccgcatgatcactagttggtgttccgccagtaggccccgttgactggacgactggtggcgcaacagccggggcctgttcgcccttagctagcacgtagatcacttgctgatcggttactttggcagccaagttgatctgccgagcatctgcctgtggctgcatgccttgtgccagttggatgacatccgcgacccgcatactagcagtaacctgatacaaccctggtttattaaccgcacccttaatatcgacatacccgggtgaactagcacctgtcggtcgggctgggctcggtgtagcgttcgacggttgggtactcgttgcgggctggtcagcattggcagacgttcgactcgcgcctcccattgatgtggaattgaacgaatgcgccaacaagttatccgtaccggcgggttgaggctgcttaagttgactcagtgcccatcccgttatcaaaataatgatcacggcagtaacaccaccaacaatccgccagtgcattttgagcagcttaatccaatctatcatttgttttcaccccttcagcgaatagtcacgcaaaaggagcggctgcccatgaaaaaagtttgggttttaccccaaactttgctaacttgcatttcaattttactattggtgtgtctgcaaataatgaacggcctgtttaaatgaggtcactggaacaactttcatattaggcgcgtactttttcgcggtcgctttagcaagttgatagttagtttgacccttttcttcaaccgccaaaagcgctttggttggtttcacatacggtgcaaagaaaattgtcgcccctgcccgcttagcagcaatcactttcttgtcgataccaccaatttcaccaacttgtccattttgatcgatggtgccggtccccgcaatcttccgtccgtgtcgcaaattctgattagtcaattgctgatagatttgcaagctaaacatcaatccggccgagggacccccgatttgtccgggatcaaccttaaccggaatagtcgtcgtcactttaatattatcagttaggccgataccaatcccggcgcggtgcgtgctcagcttgattaggggcgcacttgcttgcttcaaatggccctttcgccgatacgtgatcgtcactcgatgtccgacgccctgcttaccaatataatgctgatacgcactggctgtattaaaatggtggccatcgactttcgtaatcgtatcgccaacttttaactggtttctaaatttcgaattagactgaaccgttaaaacgtagataccctgataaaccttgcggtattgctgatgcgcagccgaatacgccgtcgcgatagcttcgttgattgcacttcgcatataaaacttctgaacccgattataagtcgcgtcatcctgaccgccagtcatatcctgagcactgaccacgtcatagtgcggattcaattgtgcgtaaagccacaacagcggcgtcgctcgagcttctgcgaccgaggtcaacataaacttaccccggtgatgatccggatgccgcttgacggtcacaaaagtcttcaaattgtttgcacttccgggtccttcaatatagtacggtaaaggaattagaaatagtgcaagtaccaccagtatcacgaccagcaagccccagtaacgttttaacaactcccggcccttagtcatgctgatcagttcctaaccgctgatggagtttttgtgccaccgcggtcgggacgtacttggaaacgtccgctcccatcttggcaacttccttaattaagctggaagaaaagtaagcgtacgggggccgtgcaatcaagcaaatcgtttcgatcgtctcgtctaatgacttgttcatccaagcgatatcacgttcatacccgaaatcctgttcattccgcaaacctcgtaccaaaactgtcgcatggacactcgccataaagtcaacggtcaaaccagttgcggcctgaacttcaacgttgggtaaatccgtcagctcatcactgatcatcgcgactttttccgtcatcgtaaataacggttgcttactcgtattgaccatgacggccacaatcaaccggtcaactaatcgactggcacgttgaatcatatccaagtggccccgtgtgattgggtcgaaactccccggaaaaactgctgtcaccataacttacccgacctccgttactttttggtaaatggtaatgaccgtaataccgtaatcttgttgtctgatcaactcaaatccgggtaagaccgttggcaagttcgcattcgtatccgtctcacaaatgatccggcaacccggattcagcaatcctagtgcatcacaatgctgaatatccttcacaatctgttgcttggcatagggtgggtctaaaaacacccaatcaaagtgttcatcttgggatgctaatcggtccaaaatacgctcagcatcgcctttgataacttcaaatcgtttgggggcttttgtaacggcaatgttatccttgatcgtcttgatggcttgatactgccgatcaatcaagacggcccgagccactccgcgtgatacagcttcgatactcaagccaccgctcccagcaaataagtctagggactgcccaccatcgaaataggggccaataatattaaaaacagcttctttaactttgtccgtcgtcggccgagtttgcatgcctggcacggctttgagccgtcgaccaccaaagtctcctgctacaattcgcatttcatcttcaccaacttaatcctcatcatcgtcatcaggcgcaccagtcgtggttggcttaaaaaagccttgatccacacgttcgccaaagttcattgcaacgtccgggcggtatgacggttcaaccctgcggacaaaatttaattttttgattttcgtggtcgcggccggaatttgactttcatccatgtacaagaccacataatgctctttacgcgattggtattgaattaatccaaaacgtttcaattgacgcacctgcttcatcgaatgcatataaacgatgagcgaccggcgcggtttaactgtaaaatccatcgaacctcacctcttctactagcattgctgtttaaatgttaggctagattcagcatttcgtcaactaagttcttaactacgcagtggtttttattggcgaagcgctgaagctaaaaaacactagtaacctaagccactagtgtttttgcttgaaatatccttattgtggtgcaatctcgagcagtaagtcatccgtctgaatgacgtcacccgcattaacataaatatgttcgatgaccccatcttccggtgcctgaatggttgtctccatcttcattgcttccgtcacaagtaatggctcacctttcttaaccgtttggcccttcttaactaacagtttcagaactgaaccactcatcgttgcgccaacttcatcttcattagttggttccgccttgcgcgtgctggttgccgattggtgaatggcattgtccttgaccataatctcttgattttgaccattgatactaaagtaaagtgtccggacaccatcgacatcgggatcactaatctgattaagcttgacgatcatcgtcttacctttggctaactcaatattgaccgtctcaccgagccgcatgccttggaaaaaggtcggtgtgtctaacagtgatacgtgcccgtaacgcttatggctagcgtcgtaatccatgaatactttcgggtacaggatgtagctgagcacttcctgatggctcgcttcatgaccaagtttagccgatagctctgctttgaccgcagcaaagtcagctggtttggctaaactaccgggccgaacagtcaacgctggctggtctttcaagacgatctgctgaagtttctttggaaagcctccgactggttgaccaagattgccagcaaagaaattgatgaccgatgctgggaaatcgagcttggtaccctgattataaacatcgtccggtgtcaagtgattttccatcatgaatagggccatgtcaccaacaactttagagctgggcgtaactttgataatatcaccaaacatatcattgaccgtcgcatacatcgtcttaacttcttcccaacgatccccgagaccaacagccttagcttgttgctgcaagttagaatattgcccacccggcatctgcgtctgataaatatctgtctgtggtccggtcataccgttcgagaagtcttggtagtatggccgtacgccttgccaataccgattgatggcttcaacgttgttaatatcaacatcaggttgacgatcattgtgggctaatgcgtaatacaacgaactcattgatggttggctggtcgtgcctgatagcgcactcgcagcaacatcgaccacgtcaacaccagcttccactgctcgggcataggtaaagattccattaccagtcgtatcatgcgtatgcagatgaactggcacggacagtgcgtctttcaatgtcgatactaattcataggcggcctctggctttaacacacccgccatatccttgatggcaataatgtcggcaccagttgattgcagatccaaggccagctgacgataataatcaagattgtatttttgccgatcagggtccataatgtcgcccgtataacaaatcgtggcttccgcaatcttcccagtttccttgacggcctgaatactcttttccatttgaggaatccaattcaaactgtcaaaaatgcggaaaacatcaatgccactcttagctgcttctaagataaattcgcgaatcacattatctggatagttctggtaacccaccgcattggaaccacggaacagcatttggaagagtgtccggggcattgcctgccgaagttctttcagccgattccagggattttcatttagaaaacgataggccacatcgaacgtcgcaccaccccacatctcataggagaataactgtggcaacgctttttgtgaagccgcggcaacggctaacatatccttcgtccgcatccgcgttgcaaataaactctgatgcgcatcccgcatggtcgtatctgttaataacacttgcttctgggctaacaaccactgttgtaatccctggacaccttgttgatccaacacgtcttttgccgtgacgatgtcgggtgcgatcggttgaaaatcatccttaaactcaacgtccggatagtacttctttgaatgttgggcaacgtcagcgaaaccattgaccgtcacattcccaatatacttcaacatcttatcttcacgttgcgtatcgtcagggaatttgaagagcgttggggtctgatcaataaaccgggtccccgcttcacctgcttggaacgttgggttgtcaatcacattcagcataaacggaatgttcgtcttcacgccgcgaatatcgaattcaactaggacgcgtcgcattttatgaacggccgctttgaagttccgcgccgcaacacaagcctttacaagcagtgaatcaaaataaggcgttacgattgcgccggaataggtattaccagcatccaaacgaaccccattaccacctggtgaccggtacgtctcgatgcgaccagtatctggcataaaatcatttgcgggatcttccgtcgtaattcgacactgaattgccgcacccttatatgtcaatgcgtcttgatgtggtaaccgtaaatcctcgaataggtcaccacccatcgcaattttgagctgagcatggacaatatcgatttcggtaatcatttctgtcaccgtatgttcaacttgaacccgcggattaacttccatgaagtagaattggtccccttcaaccaagaattcaaccgttgcggcgtttaaatagtgtacactcttcatcaagtcgactgcggcgttacagatcttttgacgcaactcgattggcagggccacggccggtgcaaattcaatcaccttttgattacggcgctgaacagaacagtcacgttcaaataaatgcatgacattgccgtgagcatccgctaaaatctggacttcaatgtgtttgggattcgcgatgaatttttccaagtaaatctcgtcatcaccaaaggattgcatggcctctgaacgggcacggtcaaaagcttcttgtaattcagaagcttcatgaacgatgcgcattccccgaccaccaccacccatggcagctttgatcataattggataaccgtattgctgagtaaactgtaacgcctcgttcaggctagtaaccgggtgtaaggtgctcggaatcgtctgcacgccggcatcgcgagctacacgtttggccgtaatcttatcaccaaacatctcgaggtgctctggcttaggaccaacgaaggtcatgccttcttcagcaatccgccgagcaaaagtagcattttcagataaaaagccgtaacctgggtgaatcgcatccacatgattttctttagcaatgcgaataatatcttcaatatccaggtaagccgcaatcggcgccttaccctcacctactaagtacgcttcatcagctttaaaacggtgaactgaaaactcatcttctttggcgtaaatcgcaacagtctgaaggcctaattcgtggcaagcacgaatgacccgggtcgcaatttcaccacggttagcaattaatactttcttcaccaaaatccctcatttccaaataaaatcgtcttagcctgcctgtcgaactgtattaaggcgcgccattttttcaagtgcactaatgtttaataccaatcctagtgaaagcgtcaataccatcatgctagaaccaccataactcatgaatgggaaggtcaccccagtaatcggaatcagaccaacgatcccacccacattaataaatgcttgaatggtcatgtaggctgcgacaccgtaacagaccaacgcgttgaacgtattagtcgcacgaaccccgatatagatcgtgcgcatcacgatgacaagtagtaagcccattacgattaaaatgccaattagtccgagttcttcggcagtgattgacataataaaatcagtgttcggttcgggtaaataaccacgtttttgcaaactattcccaatcccaacgcctgtcaaaccaccgtttgagatggcatagtaagagttgactaactgcgtccccgctcctgaagccgttttaaacggattcaggaaaccgagaaaccgccgtaactgataagaatttgcaaaagcactttggggcatgcgactcactaaaggcactaaaatccattcaaaggccgcgaccgccccagcaaagacaccaacacctacaaagtatgaaatgccactcgcaaacaaaataaccgccgcgatggctaaattaatcgtggccccaccaaggtcgggttgcacaaaaatcagtaaaatcatcgcgaacaacatcacaaactgagcacccaattcacggattcgagccaccccaaaatgtgcctcccgttgagaaataattgatgccaagtaaataatcaggtaaaacttgcaaaattcagctggttggatcgagactggtcccaaaatgatccagccagccgccccattaattgattgaccaaccaatcggaggagaaccagaacaaataacatcgcaaaccctaacataccaagtaacttggtttgcttaaaatagtcgatcttcaaattcatacaaaccaaggtgatcactaagcctaagacgacccagatcagttgtttaactaaataaccggtgggtgtcgaaccgttttgtgcggctacgtatgaactcgatgaatagaccatgacaacgccgatcccgctgagaatcaaatacgggataaacagcacatagtccatatagtgtaactttttccacatgagcttaaatcccaccctaattaatatctcaattcggattatcccccacaataacgcgaactgtttgcttgcaacaattatagcataagtcgattttaacacagcattttcacatattaatttgttgttttttaatcaagtttggattactgatttacaaactagtgcatttagtctcattaataaccggctggtaacgcctccaaatcagtgtattttccttaatgaacgtacctagacgatttgaacaacccgcgccgttccggcacttgacgtcggaatgaatttgtcgcgcattaccacccataacgcgataagcgcccccgaaagagccaacaatcgacaacgtgaacgataaaatagccgtggtaagccccatttaggacccaccacagctattttggattgctaaccgctcgttaacgatcaatttcgtgtcacgcactgggacgattgcacgctcactcggcctcatctgccgcaatcgcggctcgcaacttacgctgataccaatccctaacacgctggatattcgcaactgcccgttcaaatgagaatgctcccagtaatagcaggcacggtaagtactgaattaagtaccgactccgaccaccttcgaacaagaggaggaagataaacccaccaatcatcgccaaccggagcaattgaatcaattgccagcgcgggccaaaacccaacgcgataattacgagtagtactaaccaccacagttgcgccacaaaccgaaaatctgcaatatggcgaccgtataaataaataaagttttttaaccaattactaaagccctggttgcttggtttttgattttcgcgaaagaaattgccttccttcaaccagccaaaggtcccgtcagcagtattattgcgttgcttttttaccaagaattcaaggtaaccccacggtcccagtttcttgagctgacgcttcagcatcttgattgagtaagccgttttttgtgccttggtgggcaaaacggccatctgtatcgcctgcttttcactatacccgccggagccgtaaacgcccatggccataaagtgaatcgccggaatcgaccttgatttatcgattttgatatacgtctggttctggatggcctgattcgtataatgataagtgaggccggcactttcgagcatcaagattgccatggcgaccgtcacaaaaatcatcgtcgtttgtgaaccctgccgcgaccgcaaacgtgctaaaaagctgatgatggcaatggcgattaccggaataatggatgacggtttcatgaagtacgttaatgtcacgctcacaccgaacccaacggcggcggccacacgcagtaacggcggtcgcttcgtttgactcatcacaaaatagcacagcatgaaaaacgaaaccagcggcagtccccaagcatccgtatacggcataataatacttggaaaaaccgctaaccaaccggcgtgcagatacatagcgattcctaacgccgagcgtcgtaccacaaatacgctcattaaattgaaagctgctgaaagatcgacaaaaaacagcgtcacgtaatcaaaaaattgccatgaagtttgaccagtcacttccgatagccagtgcataaaaagcatgattggcatgttgttttgattaagactgtaatacgccgtcacgcccacctcctggacgtgtttcgcactggtagccgcatagtggagcatcccagcgtcaaaaccactgacgggatggacaaatgtcacgaatacgagctgaccaataaaaacgagtgctaacaagacaccagccgtccggagctgatttgtgattagtagtcgatatagcacccgatgaacgcgcggatacgcatagttcataatcaacacggcgacaatcacaataatcaaccccgtcgtcaataaggtcgtactcgtcccaaacgtcgcgttatcccctaaaataatattcggcgacattactgcaaataacaacattggtgcaaatagtaaccaccaaacgcttgtaatcatcttctgactaaattgataaaaataacgtctcatcattaatctacttcgtttgaattcttgcacctgaactaaacaatcaagatattccgccaacttcgcgtgatatcttgtagtcagccaacacgtgccgcttcaactcattttcctttccggcgtcgatagtgattgtgaattgtacgcctatcatcacgtaagacggccaacaaccgttgccattcttcggtgaacccccgcattttccaagttgcctgggtcgtcatcgcattgataacaccaatcaatcgaatccaagctgtcaaaaacatataaagtggcagcgttaatgttagccaccataaatgcttgtagaaatggcgttcttcaggatacggctttaataaaataccaacactaataaagttaataacccctaccatgacgtataaactatagatcaagagatatgagagccccacgaccacagttgaatagccaaaagcaatcaaaacaatcgtcgcaaaagtccaaatcattcgtggaaacgtaaacgtgtgatcaatcataattcgccgcaccaaaaattctttgaaaaagcccttgatgctagctgtttgtgacgtataatgttgtgcaacttccagttcaccacgttgccagcgctggcgttgcgtatataactcggaaaagcctgaaattggcgccacataaaaaatagcatccgcacaaataacgacctttttgcctaaacgtgtccgaatctgaaacgtcatgtccgtgtcctcaccgattgtatcggtgtcatacaagaaagtttccattaacacttcccgtcgaaatgccgagaaagctcctgacatggtaaacaactggtcacggaacgactcgatggtacggccagaaagaaaagcctgtgcatattcgtaatactcatttttagccaacagccgatgccaccaaccatgaacttgcttaaccaagtttctttgtgggagcactgccccggtcatggccgcaatctgctcatcgttctcgaatcgtagtaccatatttttaatcgcgttgggttccaataaaccatcactatcaatattaatgacataattaccaatactctcgtaaatggccgcgttaagcgcgcgagctttccccttgtcagtattgacataccgtaaaaataaattaggaaacgcattttgggcgcgggcatacgccccaaaactatcatcggtactctgattattcgccaaaataatttgcatgctttttttatcatacgtttgatgatcgatggaacgaatgcagtcaaataacgtatcttcagaattataaaccggtacaatgatggttacccacggccacttagcaggcgctttaagccggggcatgtggcgatgtagtcgcattaacttaatagtcgacataattgccggaataatttccaccacgatcggcactaaggcccaggtaatccaaaaccccattctagtcagcgctaagtttatccagtacatcacaggattcgctccctccaatcaataaactgctgataaagtcctcgagctaactgtgaataggtaaaaacattgtaatataagacaatgaccagaacatagaacagtaaccgcccaatcactgaatgagccagaaagaatgtttgaccaccgccaaagtgaacaatcacaatcactacggacaggcgtaatacattaatcaagtaaatatacaacaatcccaaaacaccataaaacaccttttcacggcgctggtaagccgggtaaaaggctactagcgaaataaatgcgcacgtctcaatgattcccgagcattcataatcaatcgacatgattaccggattaccactattaataatgtagaccaggcccattttgaacataatactgcaccaaccggtgatatcactaaacagcgctaccccatgaatcacagcgtgggtaaaaaatcacacccaatacggacgactaattgccgtcaagataaaaaagagcccggcgcttcccacaatgaagtagaaggcagatagccgagcccgtttgagcactgacagtccgtataaccatatcacaatccctagtaggatctttacattcatcgtacatcagtcctattaattagcttaccgacgcgcctaagccgccggtggttataaattgattgtcagtaaattaaatatcattagttcaatagttatcgattcaattcacatcgtgcaagttaatctatctttaatcatgattaaaacgtgccaattttagattcctgttcgtcagccggtgcgcgtcctatgccgacctccggggctgggtgccaattgctggaacgcagccgacgtcgatttgagctaacgcataacccgcgtcatctcaaatacgagtcttattctaagccggaagaaagacacttccgactaagaataatttggctactgagcattgtcacccagcccctccggtcgggaagccgctcgaatggctaatgaacgaccatcgaactcggtacaatttgtcgttgactattttgatactggaattttaaacaaagcgttaggtgtattaagcactccatcaagagattaaatctcactacaacaatttaggattagtgagctatctcaatatcattttcagtctgacagttgattgacaaaattatggtttatgaaaaacaatgacgaattcaccaaaagttgggtacgcacatgtccgccattcgaacactgtcccgactggaaggcgtttcggccaatgctcagcggtgaaattccacttagcaagcgtccttggcttggttagtggaagaccagtatttaagacgtgggttgcggcttaaatctgtgtccaccgcgttccagcaattggccgaaatgcctggaagtcggcttaggacgaaccagcaaaacaagtttacaccaactcgtatctatttccagcgggtttaagctggctgcttctgaatttaaaggaacggcacgttttaatcgtggttaatgctaaataataacgagcacaacatgttatcaatcattagttcttagtggtcggtaaatccgttgcagttaatcgacgccgcttgcggaatttaaagtatccccaagcaacgattacgacaccgacaccggaaattacgtacggaccagttgagcccccggccacggtcattttttgattaccgatattcggattggacatcgtaatcgtttggccggtcatcgttgaaatatcgaacttgctcaagtccactcggaattcagcaatcgaatgtgaaccggcttgagaaacatacccgttgccgaccgtcccgtactgatggccctcattgtacttaccacccgtaaatgagacatctttgaccgccccgtcgctttgcgagctaggcatctcattggaccacacgtaatacttctgaccaccaatgtcgaaattataatccccgtaaccgggaacctgtccatacttcatcttgacataaacgtagacgtacttcccgtcactaaccattgccatataaccgttataaccctcggtcaaagtcacgttcttccaatcattaaagttaccatcgattttaatgttgagattatcattgtcattggctgcattattgtccgtcgtcgaggacgccttggaagagaccgtgcttttatcagtgatcaccccagctgagctagttgctgaggaactggctgcactactgctgctagtcttagaacttgaactagttgtagaattcgcatttgtacttgaactggtactactacttgagctagttgaagtcgccgtaattgttccaacagtgctagtcgtagagtcactgccgatattcggattgaccatcgaaatctgcttaccactcgcactgtcagttaatcctaacttggttaagtcaatctgaaattcggcataattatgcgaaccgtcgttggtcacatatcccgtcccgacagttccatactgagtaccatcgttccatttaccaccagttaatgtgaaggacttgaccgttcccgagctaacactacctgaaatattcttagaccaaatataatacgtcttaccatcaatagtgaaattatagtcgccatatcctggcacagcaccatttttcatcttgacgtaaacattgacatactggccagcactcgcgagtgccgtgtaaccattatagccctccgttaacgtcgcatctttccagtcgttcatcttgccatcaatggtgatgttggcgctagcatgcgctgcggtcgtcatttcaggattgatcattgttgcccccgttaccccaaaaacgagcatgcctaagatcatcaacttattaatttttttcacgatgatcacacttcccaagttcaataccattttaacgggtaacgaagaccattagactctttttaccctataaactaatactatactctggataacaatttatcaatcattatttccatctaaatgaacccaataaccattaatgggacaatatttgagttggtgattaaacgactcctcttcaaaccgctttggccgatacagccttaggcatgccagtaccaaaaaagcacgccctattaaggacgtgcttccaagcaatcaacttacttgttcattttacgctttttagcttctttttcacgggagttcgtgttcaaaatgcgtttccgcaagcgaacatgatctggcgtaatttcacagaattcatcactattcaagaattcaagcgattcttccaatgtcaaatgcgttggcgtcttgattgtcgccgtcaaatccttgttagaagaacgcacgttggtcatgttcttacccttagtaatgttaactgaaatgtcattttcgcggctgttttggcccacgatcataccttcatatacttcggtacctggatcaacaaaaatcgttccccggtcttcgattcccattgtggcgtatgtcgtagtcttaccctggttgattgaaaccaaagcaccgttacgacggcctgggttccagttaggaataaccgggaggtattcagagaaagtatggttcatgattccgtaaccacgcgtcaatgaaaggaattcagttgaataaccgatcaagcctcgtgaaggtgctaagaaagtcaaccgggtttggttattaccagtactttccatgttcttcatttcagccttacgctttgataaggtatcaataattgaaccagtatattcgtctggcgtatcgatttgaacagattcaaatggttcgcaacgcttaccatcaatttcgcgatagataacttctggacgagatgcttgtagttcataaccttcacgccgtaacgtttcgattaagattgacaaatgcaactccccacgaccagaaacgacccatgaaccaggttcgtcagtatcatcgactcgaagtgaaacatcggtttcaagttcagccttcaaccgcatttcaagttgacgggcagttacgaacttaccttccttacccgcaaatggtgaggagttcgtaccgaaagtcatttgtaaagttggttcgtcaatccgtaagattggcaaagcttcaggattagctgaatcagcgaccgtttcaccaacgttgatatcttccatcccagaaacagcaactaagtcaccggcgtgagcttcattgatttccaaacgttgaagaccaaagaacccaaacaacttagttacgcggaaattcttcttactaccatcgagtttcatgacagaaacactgtcaccaaccttgatcgtaccacggaagacccgaccgataccaacccgaccaacataatcgttgtagtctaataaggccacttggaattgtaaaggttcgtcagagttgtcaattggtgatgggatcgtcttgatgatcgtatcgaagattggttgcatcgtatgttcctgcttagcaggatctgattcataactagaagtcccatttaaagctgaaacatagaccactgggaagtctaattgtgattcgtcagcacctaattcgatgaagaggtctaacacttcgtcaacgacctcttcaggacgtgcaccggggcggtcgattttgttaataacaacgattggtgttaggtgttgttccaaagcttttttcaaaacaaaccgagtttgaggcatcgttccttcaaacgcatcaacaacgagtaataccccgtcaaccatgcgcatgattcgttcaacttcaccaccgaagtcagcatgtcctggtgtatctagaatgttaatttgtttgtcgccgtaacgtacggccgtgtttttcgaaaggatcgtgataccgcgttccttttcaatggcattagtgtccatcgcccgatcgtcaatctggacatgttcgtcaagggtatccgattgtttaagcatttcgttaaccaacgtcgttttaccgtggtcaacgtgggcaataatggcaatgttgcggatatcatctctaaatttcaaaattgatcttcctttccatccttcaaaattctgactatcttcgacagcagaaatcttacatatattaatacaatccgccgttactatcaagtcatagcttcaacttgaaaccttcataacgacgttttcagcggctttcatccattgacataaaaaaactgtgacatatgggtcacagtcccactacttactagacgattgccaaaattgagcgttgtgcgcgctttgtcgctatcagtacagcacccgatgataacatattaaccgggttgccgtcaactctagacacaaccaagccaaggctttccgcgagaacgcgaccagccgcaaaatcccatggtcgcaagtatgacaggtagccgaccagttcgcccgctaagacctggctaatttgaataccagcactacccataatccgtggtcccagtgatttggcaataatcgtctgcatattgaagcggtcttgaattagtaacggcgcactcgcaccaaacagccccgcactcagatcaacatccgcgggtgcagccagcaattcaccgttaagcgtgacgccgacttcaggaccaccagcatataatttattcgccatgacatcaaagatatatcccagtgttggtttaccgtcaacatacaagcccaccatcatcgcaaaatgattacgctgatgcacaaaattcatggtaccgtcgattgggtcaacgatccagacgtgaccattcatatcagtaacttggtcgccggttccttcctcagctaaaatcttcgcaactggatccaaggctcgaatctgacgcaccaaaaaattttcattgctatgatccacgttagtgaccaaatcacgccgactcgtcttctccgcaaccgtcaagtgggtgcccatcttcgccaacacttgcgctctcgcagtttgcatcacgacttgcattttctgatttaactgtttcaccacattcgtttgcacgttaagtcacctagtctcggtattgaaatcgctgcttgttagtttcctgagctgcgcgcattgtttgataaatccgataacctgaagcagcctcataatcacgagccagtcgtttttcttccgacttagccggaacgaccgtcttaaaatcacgataggctgccaacaagtctgctgtagcgattgttccttcattagcggcctcgatggcttgataaaaggtcgtaaccttaatgatctcggccgtggtccacgtctcatccagtggatattggtaattatcattgtgtttaggcatcttcatccaactcccccgccgtgacccggtcaagttcctcttgaacctggctcgcaatctcagcgtattctttctgctcttcatcagatagcaccatatccgccattcgtttgattccgttagcactaatcagtaccggtgatgataatccaaccagctggtcgtcatcgactggtgtttggatatttatgacggtaccgataaacggtgtctgggcgtaaaacgcattgagcacttgtactaatgctaacacactcaaggtctgattagtaacaatcgtggggtcgtcgatctgctccgtcgctgcactcatttcgtccatcccaaaactaatatcctggttagccaaataagtcatcacgggcgccggcccaatatatgaacgactccatgagatcaggtgtgtcgccgcagttcccactacgaatgcgcggacatccgccgggccgacacttaattgctgacgtagtagttgctccaataaacgactctgcggcaaagtacccaatccgaccactttagaatgatcaatgccactgaaacgcgcagctaagacacttaaaaccgcatcattgctaccagccaaaataatttttccgttaaaaccagcgcccatcgcatcattcacaaacgcgcgaaatagcggcaaagtcgcctttaaatcaccactggcatcacggtcgcttgccaatggcactaaatttccaataatcaaactatctgcttgcgaataatccggcttagcttgcgccactagtgtaaactgacgacaagttaaactcgctgttaccagtgcttggtagcgtggcgcttcttcagcacccgttgcgaccactaatttcactggcaaatctttggcaattgcgactaatattaattgttgtacgaactcgaataatccccgaataattactgtattaatcatttcaatccctccaaccttcgataataattgtacctgagctgtcaatgaattcaagtaaatgttaataaaaagcttactcttttgtaacatttttgcgtaaccaattggtccacttccccccgaagcaaacacattttgatatgttattaatatagaccactacatgctaaaaagttagcaatttgaataacaacatccacgtcaggttcaaaggcgtcacttacggatcagctgagtaatgattcacaagactgaccttcattgcgcctgacagtgccgtttaagttacgtttttacgtgactatcttgactggtacttcggtaatccacactggctgcaacatcctatgtaaaataaaagtttgagactcacgcctcaaacttttattaagccatcatccgctttagatgtgcgttgggtaacccatcgcttcatccgccgcttcttgaactacttcacctagggtcgggtgtggatgaatcgtcaaagcaaggtcttcgacattcatcccaccattgaccgcaacgcttaattcagaaatcaaatcactggcacctggtccggcaatttgggcgccgacaatggtgccttcgtccttcgtactgacaagacggaagaagccgtccatggcgttcaacgagattgcacgaccattaccagcaaatgggaacttcgacgtcttcacctgcaagccggcttcttcagcttcagccttcgtcatgccaactgttgccaattctggatcagtaaagcaaactgccggaattgaaacgtagtcgttcgccgtcttcttgccactgattgcaccagcagcaactttggcttcagcaaaagctttgtgtgccagcgcagcaccggcgacaatatctccgattgcgaagatatcctcagcggccgtccgcccctgttcatcaacttcgatcaagccgcgcttcgttagcttgacgtcagtgtattccaagcccatgtcgtcagtattaggccgccgaccaactgtgaccataacatagtcagcatgaatctcagtttctttcccgtcgacagcgtaggtaaccgtaacaccactatcatcttgttcggagtttttagccatcgcattagtaatgacatcaacccccttcttcttaaagctgttcaagacaagcttgaccatatctttttcgaagttaggtaagatttgcggtgtcccttcaagaatcgtcacgtgagcaccgaggttggcataggcaccagccaactcagaaccaatgtacccaccaccgataaccactaattctttaggcacttcgggcaaattcaagccacccgtcgagtcaacgacccgaccactgaacttgaagcccggaatttcaactggccgtgaaccagttgcgatgatcaaatgtttgaatttataagtctgaccagtatggtcaccattcatcacccgtaaggtatgattatcatgcatataggcttccccacggaccacttccaccttatgcttcttgagcagcatttcaacgccaccagtcaaccgatcaacaacttgatggtctttccagtcctgggtcactttaaaatccaacaccggatcctgaatatttttaataccaaagatcttactgtccttggcttcttgtagccgatgaccagcactgatcaaagcttttgatggaatacaaccaacgttaaggcagacaccaccgatatattccttttccaccacggtgactttttggccgagttccgcggcccgaatcgcagcgacgtaacccccagggcccgcgccgatgatcattgtatcgcgttcttcagcaaaatctcctacaaccattctgacctcatccttccatcaaaagtaattctggatcatgtaacaattgcttcaataagttcattgcccgttgtgctgttgcaccatcaatcagacggtgatcaaaactcaaggacaacttctgcatcttaccaacaacgatttcaccatcgtcattgacgtaaggttccttaccgatacgcccaacacctaaaatggcaacttccggttggttgataactggggtaaaccagccgccaccaattgagccaatattactaatagtaatagacccaccactcatttcactggcctttaacttgccatcgtaagctttttgagtattgtcagtaatttctttggcaattgcaaacaagcccttaccttcagcgtgcttaatatttggcactaacaatccacggtcagtatcggtagctaccccaatattgaagtagtgtttgtaaacaatttccttgtttgcatcatcgatcgacgcgttcaattctgggaattgttgtaaaaccgcaaccaaagctttcacgaagtatggtaagaaggtaagatggatgtcgcgatccaaagcaacttgcttgtacttcttccggtgtgccatcaacgcactcacttcaacttcatcaaataaagtaacatgtggcgcggtgtgtttactgttcaccatagccttagagattgccttccgaattggcgtcatcttttcacgcgtctctaattcaggtgtgtcagaaacatatggtttaactggtgttggtgctggtgcttcacttgcagccggagccgttgtcgctggcgtagctgccggtttagcacccgttgccgctggcgcacccgtgtaattgtcaatatcttgctttgtgatctgaccatgggcaccagttggcgtaactaacgtgatgtcaatgtccttatcacgtgcgtactggcgcactgatggcattgccaagacccgtttattaggattgcccgcagccggggttccagtcggttgtgctgatgttgcagcgggagtttcagctgcttcacttgccggggcttccgtcttagtagccgctggtgtttcagccttagccgctggcgcagcgtcgccagaaccatcgtcaatcgtgacgatcacatcaccaattttagccgtttcaccttctggaactaaaatatcaataactttaccacttactggcgatggtaattcttccaccgatttatcattttgaatttcaactagagaatcgtcttctttgacttcatcaccaggttttacgagccatgatgcaatttcgccttcttcaagaccttcaccaagctctggtaatttaaactcgtaagccattggataacttcctttcatgacagtctcaggtgactgtttttcgatgccgcgtcttgattaatagttcaagatttcgcgggtttttgcctcaatttcatcttcagctggtaaccaatcgtcttctgctaatccgaatgggtagaccgtatctggtgcgtacacccggccaactggggcactgagataaagcgcacctttttcagcaatcagtgaagcaacgttcgcagcaatcccagcctgtcgttgtgcttcttgaatcgcaacggcccgaccagtcttttgaacagacttgagaattgtttcttcatctaaaggtgacaaggtccgtaagtcaacaacttcaacggagattccttctttttcgagcttttccgcaaccttcagtgactggttaacttgtgcactgtaagcaatcaaggaaatatcagtaccttcacgaaccacgtttgctttatctaacggaacggtataagcttcatccggaatatccgccttcattgaccggtataacttcaagttttcaaggaagaaaactggatcgttattccgaatagaagaaattaatagccccttggcatcgtaaggattagatggcgtcacgacccgcaaaccaggaatttgagctaaatagccttctaatgagtccgcgtgcatttccggtgtatgcgttccaccaccatatggtgaacgaatggtaatcggcatatgccgcgtgccacctgtccggaaacgttcccgtgacatttgaccagcaattgaatccaaagtttcaaaaatgaatccaagaaattgaatttcagggattggccggaaaccttccaatgccagcccaattgataaaccgccaataccggattctgctaaaggagtgtcaaaaacacgatcttcaccaaattcggcttgcaggccatcggttgcccgaaagaccccaccgtttttaccaacatcttcaccaaaaactaaggtcttttcgtctgacccgagttctaatcgaagtgcatcggtgatcgcttgaatatacgttttctttgacatgttacttcgactcctttgcttggaattccgtaatttgttgttgaatgttttgtggttgttcctcaaaaacattccccaagaattcggtcattttttgctttggtgcttcatctgcttgtttaacagcagccttgatatcttctttaacttgttcaacgtattcgttttcttgatcttctgaccaaacaccttgatcagtcaagtacttacggtaacgaatcaatggatcattatcgaaccaaggctgttcttcgtccttagtccggtaacgcttaggatcatccccagcattcgtatgtgggccaaaccggtatgtcagcgtttcaatcatgacaggaccgttgccagcagcagcgtattcccgggcggcctttgttacttcataaacagctaggaagtccatcccatcgacctgaacacttggaataccggcagcaactgctttttgagccaacgtcttcgcagctgtttgcttgcgccgtggtactgaaatggcataaccattgttttgaacaatgaagacggccggtgcttcgaaggctccggcaaagttcataccttcatagaagtcaccttgcgaagtcccaccatcaccagtataagtgtaggcaactttgtcttcggtaccgttctttttaatccctaaagccacaccggcagcttgtacatattgagcgccgataataatctgtggtggcattgcatggaagtcttctggatattcgttacccaagacatgaccacgagaccacaggaacgctttgtaaacaggtagtccgtgttgaatcaattgtggaatatcacggtaagcaggcattaaaacgtcggttttcttcatcgcggcgttactccccatctcactggcttcttggccctcagtcggcgcatagaatcctaaacgtccttgccgtgtcaaagcgttagaacgttgatgtaacgtccgttcccataacattaatttaaagaattcaacgagttgttcgtttgaatatttagagacaatttctggtttaattactttagcttgaccatccaatacttgcacgggctcaaagtctttcccaagtgcatcgcggatcgcaccaaaatcaacaattggtttttcgttgtccataaatgacacatccctttcatgaacgtacaaacgttgtgcatcgcaccacgttcgtaatcgttttcataattacaagtctaatttaccattgcgtttcatcttttgcaagcccttccaaagagcgaaaagccggctttttctgtccaaatgattgtgaactatttaatttgtgcttagttctgttttcatctttttcataacgggcgctactttttggcgtaggcttatgataaactagatattaagtgtaaactgcgcgatcttaattttggaggtaattggaattgattaaaatgcgcgacattatccgcgaaggtaatcacacgttacgcgcggaagcaaagcaagttaaatttccgttgagtgaagctgatcagaagttggccaatgacatgatggaatacttagaaaacagccaggatcccgaattggctaaaaaatacggactgcgtgccggtgttggtttagctgcaccgcaagtcgacgtttcggaacagatggctgctgtccttgttccgagtgaaaatgaagatgatgaaccggtctttaaagacgtcattatcaatcccgtgatcatcagtcactccgtccaacccggcgccttaactgaaggtgaaggttgtttatccgtcgaccgtgatattgctggctacgttattcgacacgatcggattacgttacgctactataatatggctggtgaagagaaaaagattcgtctcaagaattatccggccattgtttgtcaacatgaaattgatcatcttcatggtattttattctacgaccatatcaatggcgacaatccatttgccgctgatgatgatttagttctaatttcttaaagtcatttaaaaaagcagtcctgaaatgttcaggactgcttttttggtgcactcgaattcaaccgacgcaaatcttccaaatactctaaagtggcctcattcatcaaataggcaatatctaagtggagctgtccgctgcgcagccacgcatcagtcactcgtaacgctggtccagcttcccggaaagcaaccacctgattgtgaattgcgtacgcttgcaattcgttattgaataatcgccgaacttctggcaaatcggccgtgaccatgcctggtgcatctagcacgtactcaaaggccatcacaccacgcccccagacgtctgcgacgggcaccgaatgaatcgcccccgcaacctcttgaatcgtcatcgcatttgcgagcactttgaatgctgctaccatcgcactatcaaccgttcgttggccagcccgccgaatcttcaacgccgcacgcttcagcacttgccgtcgcagcaattcataaacgacgattgccattagtaccccaccaatgattgttaaccaactctgcatgctcaaccctcaattctttttttgtataatgattcacaattttaggaatttttcattttattacttatgtttagcatagcatgtttcatcaaaaaaaattcttttaaccgctctatttttgaagaaagttaacattgtatacacccatctcaaattatgctaaaatgtaagataattgttgtgtttacacaacctggtgtacggatcaaacttttatttttgctatctatttagattacttagtatctaaataaatcttgtttatattaaggagttttacgcatgatttacaaagtatattaccaagaaaccaaagaacggaacccacaacgggaaacgacccaatctttgtatctcgaagccgagaccgaagtagcggcacggaccttagtggaagataatacagatcacaacatcgaatttatcgaaccgttagaaggtaacttcttggattacgaacaaaaaaatccagagtatcacctaacggagttcaataaatgaaacggttaaacgtcaaaaataacgaaaccgctgtttttgcagtcggcggtttgggagaaattgggaaaaatacctatggtatccaatttcaagatgagattattctgattgatgccggaattaaattccctgaagatgaacttctcggaattgattacgttattccagactattcttatctagttgcaaatcagcaaaaaataaaagctttagtgattacgcacggtcatgaagatcatatcggtgggattccattcctattaaaacagatcaacgtgccaatctatgccggccccctagccttagccttgattaagggtaagttagaggaacacgggttattaaaaacaactgaattacacgagatcaatgaagatacggtgctcaagttccgtaagacgcgtgtctcgttcttcagaacgacccattcaattcctgatacactgggaatcgccgttcaaacaccacctggcacgattgtagagaccggagactataagttcgatctgacaccaattactaaccagccgccgaaccttcaaaagatggcgcatctcggtgaacgtggtgtcttggcgctaatgtcagacagtactaacgccgaacggccaatctggacgaagtctgaacggtgggtggcgcaatcaattcgccacatttttgaacaagttgaaggtcgaatcatctttgctacctttgcttctaacatctcgcggattcaagaggcagcgcaagtcgcccttgaacatcatcgtaaaatcgcggtatttgggcgtagtatggaagcagctatcgtcaacggacgtgaattaggctatttaaacatccctgacgaagccatcgttgatgctaacgatttacgctccctccccgccaataaagtcatgattctatgtactggttcccagggtgaaccaatggcggcgctctcgcgaattgccaacggtactcatcgccagatttctattgaacctggcgacaccgtgatcttttcaagttcaccgattcctggtaatacgttaagtgttaaccacgtaatcaacgaactcgaagaagccggtgcgaatgtcattcatggtaaagtcaataacattcatacatctggtcatggtggtcaggaagaacagaaactgatgctacggctgatgaaaccaaagttctttatgccgattcacggtgaatatcgaatgttgaagattcacaccgaactggccgaacaatgtggtgtgccactagaccatagttttatccttgaaaatggtgatgtgcttgcctttacgaaggattctgcccgggttgccggtcactttggtgctggcgatgtctatgttgatggttctggaatcggcgatattggtaacgttgtgttacgcgaccgccaagtgctttcggaagaaggtttggttgttgtcgttgctaccatcaatttgaacaaaaaagagatccaagctggtccagatattctgtcacgtggttttgtctacatgcgcgagtctggcgatctaattaacgaagcccggcggcatgtcttccgtacgatccggcgcaaaatgaagtcggataaagcaaccgaagcgactatccgcaatgcgattattgacgacctgcagagtttcttatttgataagactgaacggcacccaatgattctgccaatgttgattatgaactaactacttgccggaacgatctcgttccggttttttatggtgtaagactgatatgaggtgtaattttgattgctgaatactacattattattaatgaactggcaggatctggtcacggtaaggtcgtttgggaaaccgtcaagccgattctagaacaacgacagattcgatttgaatatcgaatttctgaatatgccggccacacaattcggctcgcaaatgagtacgttaaaaccattcaacgacgaccaaacgtgaccccggtcattctggtcattggtggtgatggcacactgaacgaggccttgaatggtattatgcaggtcccacaagctgaaccgatcccgctcgcctacattcctggaggttcgggcaacgactttgctcgcggtctgggtatggcgactgatccagcaattgcacttgcacaagtactcaataatatgcggccccgttcgttaaatgttggttatttccatgaaaccttgaaaaacgaacaccggtatttcgtcaacaacgttggtttaggatttgacgctcaaatcgttgatgacacaaaccgtagcaaaaagaagggccgtctgggtcgttgggcttatctcagtaacatgctggccgcatattcccaacaggaaggcttcccgctaaccgtacacgttaaccggaagcgagactattataagcgggctttcctttgtacagtctcgaacattccatactttggtggcggagttaaaattctgcctcaggctaatctgcacgatgatcagctcgaattaatcgttgtcgaagagcctcactggtggattatcctctggttgttcgtcttactgctactgggtggccgtcatctcaagtcgcgtttcgttcaccattatcgcaacgctaacttgcacttgttggttaactctgttgaaattggtcagatggatggtcaaattattgggaatcgtaactacgacctctacttgtccacccatccctacccattctggatcgacactagtatccatgaccaccactaactctactgctaaaacaatacaaattagcgataaaaagtcgttgcgaagatgctcgcaacgacttttttataggacccagattggcaattcatactacttgagcgccgtccacttaccggccagcaatgctaatgaccacttaattgactccccacccattcggctaataaaaaagactgctgaccatttcaatatggtcacacagtcagtcttgattaatcttagtcctcagaagcgttgattgcttccagaagcatgtcaagttgttcacatttacgagataagtgactcacccgttctttcaaatgcggataaatggtcacaacccgtgagcgatcctgttgccgaacggctagcgtccttaaatgatcgagttcggtattagcctcttgatattcttctagaatctcaaaacgattactcactgatagcacttccttatcacaatagatggtccaatttttcgaattgaaaaacgacaaacataatataccacaattattggtaagtttaaatcataaaattcaaaaaaatttaaataaaaatacccctaacacttaacaatatcgtgttaggggtattagcaattaaaatcggcttacttaaccgtacctgcaaaacttggcatgaagtaagaactgattgtctgaacttgaacgttttggccttcagttggagccgcaacgtattgattatttccaatatagatggcatcgtgataagtgctaccacgactaccccagaataaaatatctccaggttgagcatccgcaacggaatgcgtcgtcacataagattcctgtgcaaccgtactatgtggcaaggtaatcccagctgcatgttggtaaacataggaaactaaaccagaacaatccattcccgaaagactcgcaccaccccaaacataagggatgttggcactagccaacttcagcgcaaggccggttacagaaccagtagctaaatcactcgttgaactagtagtggtactgctactattagtcgttgcggtactacttgcggtattgcttgcactgctagtggctgctgaagaactactctgactggtcgtgcttgaactagtcgctgccgagctactctggctcgctgtactcgtagttgatgctgcactagcagctgtacttgatgcttgactagctgtgctagtagcagtcgtactgctagtactagttgcactcgcagttgaagcggtactttgactagtcgttgttgaactagcagctgatgaggacgcgctactcgttactgaggcgctcgctgcaacactcttcgactgactggtagcagtcgaagaactagcactacttgctgatacggctgcactcgttgcgactgctttgaccggtgcatttgaggtcgtagccgttgatgaagcaacagagccggtcgatgatgatatcgttgacgtgctagtactgcttgctgagttcgcactgacagcatcctgacttgctgcactggtgctacttacaacgcttgcactcacacttgaaaccgaactcgcacttgtacttgaggtggaactcgcactaacagccgtcgtggccttggcagtcgtactcgtagttgacgctgcactagtagctgacatggttgttttttgactcgtcttagcggtcgtcttggtcgttgctcctggcacttgaatgttctgacccaccacaattaaatcgccagaaagaccatttaacgtctggagagcgtgaacagaagtgttgtacttatcagcaagcgcccaaagagtgtcacccgctttaacggtatatgtacccttagtagcggctttcttagttgctgacttagtcgtggcggtcttagttgcggatccaccaatttgtaagttttgaccaacataaattaaatcgatattaccatcagatgctttaatctggttaagtttttcaatactctgcacggaaacaccgtgttgttgagcgaggccccaaactgtatcgtttgcttttacagtgattgaggcagcattggcagcttggcctgtagcaagcaataaaccaacggcaccaaccgtactggctaggaccttgcccgttgtatgtgcttgtgacatttaattcactccttagtttttgaactcaaattaacagtaacaaaatcgtcttgtgactgaagattaagaaattcttaacctgcttttacaaatcataattttattgtagcacaatttaccaaaatacaaactagaatcgctcgtttttttacaaaacagtccggttattttgaaaaacgtttgccaatgccaaagcggcgcatttggctgttatagcaacgtttatgcatataaacggaatgttatcttttgattacttcaagtaattagttgcactgtttggacgagttacgctattcagtaaaccaaccaaaaagcacattaacctttttgtaggttaatgtgcttaaagttgcgagctagatgcgaggatcaaacaaccgatcaactggttgctgttcatgtactaatttgattgcatcacccaataatggaccaaccgaaagttgcaccaacttatcaaattgtttatccgctgggatctgaatcgtatccgtcacgatgactttctcgaacttggaagcctgtaatttagccactgcatcctgtgaaaagattgcgtgagtcgcacagccgtatacggtcgctgctcccgcttgtgctaaagcatctgccgagacatcgaaccgagttcccgtatcaatcatatcatcgatcacaatggcgacgcgccctttcacatcaccaataatactacttggcactaggtcatcatcatctgggtgtcgattatcaataatcgcaattggggcccccaatagttctgccatcttacgtgcccgcgaaacaccggcatgatctggtgacacgacgacgagattatcggtaatgccacgatctttaaaataacttgccaagagtggggccgcaaataaatgatcaaccggaatatcaaagaatccttgaatctgtgcggcgtgcaaatcgaccgtcaagactcgactggcccgatccttttccaataacgttgcaattaatttcgcagtaatgggctcacgtgaacgcgctttgcgatcttgacgtgagtacccgtaataaggaataaccacgttaatttgactggcactagcacgtcttaaggcatcgatcatgatcaataattctaatattgtatcattgaccggttccgaaatagattgaatgacgaaaacttccgccccacgaatactttcttcgatgttgatctgaatttcaccatcactaaaccgctttacggaacttttgccgagtggaattccgacccgctgcgcaattttttcggctaacggtaggttcgaattcagggcaaacagtttcagtttggcataagattgatctgttgacataacgacctccataaaagttgtttgatgattttgctactttgattatagcagtaaccacggctaaaaaccgcacacaagcaaattttcttgcataatgagcgtcgccgacaatgtgtcgttcatcgtaatttcagttgcaataaccaattaattatcaattagctacttgcggcatgaaattagctggcgtgataccattcatgccaatcatcggatcgattcggccagcgctgactagcgctggggtcaaaattgttggtccagcagactgggaactcggttcctgagttttttcagtggccgactcctcgtcagaagcaactttcttaaccgccgtcgctttttcactggctggcattgcctctgcttggtcagtagtcgcaatagtggccgtttcatcggatacggtatccccgccaaagacttgttgtaaccgtttcgtcagtgtggtttggcgattaaccgattcattggtaacgctccgctcaaatgattgactatcacctaacaggatcagcatttgttcagcacgtgtcacggcagtatacagtagattgcgttgtagcatccgtgcaaattgtggtaccagtggcagaatcaccattttaaactggctcccttgagacttgtggatcgacatactgtacgctaatgtcaatcgattccattcattgcgttgataagtcacttcattttgatcaaaggcaatcgtgatctggtctttcttcgactcgttgtgagaatcatttgccagatcgataccgacgattttaccaatgtcgccattaaaaacattatcctcgggtgaattaacgaggtgcaggaccttatcaccgacccgaaaatcttgaccgttatacgttagatgcttctgatgggcactcttcaacggattaaagattttctgaaccgtggtattcagctgatcgatcccggcagtgccgcgatacatcggggccagaatttgtacctcctcagcactgaagcccttcgccttggcacgtgccacaacttgttcaacaatgtgattgacttgataagcgttgcaggcaataaatgagcgatccggttggttgacggcaaaatcggccggtaaatgaccatctttgatggcgtgggccaacggaataatactggaatcattgccctgccggtagattgtcgttaactcaatttggggcagttcactaaactgcaataaatcatgaaacacttgcccggctcctaccgatggcagttgatccttatcgccaacaagaatgacttgcatgtgacttggaatcgccgtcagtaactgctgaaacagtaccgtgtcaaccatcgacatttcgtcaataatcaggaggcccccatctaattccttactaggctcctcgggaccatcttcacgccccgtcaacccaagcaaccgatgaatagtactagctgggagcccagtcgtttcagccatccgcttggctgcccgtccagtcggtgccgccagcaggattggaaaaggcttatccttatactgattgatatctagtgcaacgtcgtgtaattccgcatagagcgcgaccaagccacggataatggtcgttttaccagtccccggtcccccagttagtagaaaaacaggcgccgtaatcgccgcttttagtgcttcggtttgtgattcatcataagtaatgttgctagctcgaccgacatgctcgatagcatgatccacggcacgttcagacaatttttcatcattatcggcggctaacaaccgttgtaaatgttccgcaacgcgccactcggcttcatagaggccgcgcaagtagatacgattctcgtcacccacgattttattttccttcgccaagacgaccaactgatcagccagcttcgaaggatcaatttgaacattgcgagcattctcaagtagttgcaacgtttgattcagcaacggttgagccgtggtatacgtatcaccgttttccacgcacaactcattaatctcagtcaatagggccgcctttaaccggtcatccgcttggggatcaattttaagttgggccgcaatttgatccgcttttttgaacccgacgcctttgatatcctcaaccaaacagtacgggttctcttgaatcttagccaaagtgtcaccttgatagcgtgcatagatggccgcagctaaccgactcccaaaaccgtacgcattaagtccaatgatagtttgctccaaaccgttattgaccgtgagcgtgtcgatcaaagtcgtctgaacgctggcccgaagtccgattggttttaaaaccttcggatcagctaaaatttgatcaatggcgtcttcgcccaaagtatcgacgattcgctcagcagtccgcttacccaacccaggaaaatcactaccagatagataggcaatcaagcctgcgcgtgtcgtgggcgtttcattttgataattatccgcttgaaactgaaccccgtatttgggatgcgtgaccgttttaccggtaaaacgatacgttgtctcctcctgaatatccgcaaaatttccagtaacaacgatctcatcttccgaccaatcaatgttctgttcagttactttgactaataagactttataaaaactatcggcactgctaaaaaaaacggcagcgactttaccgacgataaagtgtgtgaccggttcccgaccaatatcgtcggaaaataaatgtgcttgttcgtccgtcacggaaatcctcctaaattagtgattttgattatctgcttgtgcggctaacattttttcaatatccgttagctgttgctgatgacttttaaaatattgactgtccaatttctgcgcgcgttcaaaccaggtggcatacggttttcccagtaccattgcggtcagtccaaggttaaaagcagctcgcccagattgcgaatcaatcttatatgcgcgttgatagtaatccgatgcttgctgattattgcctaatgcaagtaatatgtctgctactaacaaattagcgtcaagttgttgtggacgtgcctcttgagccgtaatggcccagaccagggcatgttggtaatcgtgttgggccattaaagcttgtgcactcattaaataagcatcctgttttagttgatcatccgtaatttgttgataatatggtaacgctttgtcataagtttgagcttgataatagacatttcccaacgcataacgcaggtagtcggctgcgggttgttggtggtcaaactttcccaacgccttcattgctaacgcctctgcctgttcaaaatcttgaccagccgttaataataccactagttcataataagcatggtagtcctcgggctgtgcatcaatcttgccaatgagttgatggactagtgcttgctgtttagctttgctaggacgtgatgtttttgccatccgaaccacttccttctatattaaatcgtatcagttgcatcgggccgccgtgataggtatgaggtgtcattccaatctaatagcttaaaatgttgaccacggtcacgcgtctctaaaattgttgttgacgtattcgacaagccaccccgttgccgtaacgtcgccagtgtcgctcccagtaatgagttgaccaaggcattcaaggccgcaccatgactaacgatcaaaacattgtcatcgcgacgtggatttgcttgaacaatttgcttaatagcgggagtcatccgcttcagcagttgttgaaagctctccccctgaatcgctgtcgggtcatactgatccggatgatttcgaaacgcgtcgaattcggccggatacgtagcttcaacatccgtgaaggccattccttccatcttaccgagattgaactcccgtaaacgactcagtaccgttatgggtaactctgattgtgtcaaatcattacgtagtgtcatcgctgtatcacgcgcccgttttaacggactgacatagatatgactaaaccgaatatcctggagcgccgctgccaattcatgaatttcttgataactagtcggtaataatggtgaatctccctgagagccttgatagcgcccctcaagattccactctgttttcccatggcgaacaaataatagttttgtcaattgcttacttccttactctagtgtcttgatttgatcttattttcgagcaatggcccctccaaactgaataacggttgcgatgattcagcagtatcattgcaactcatcatcaatcgccgttaggccaaccctgttaatacttcaaatgacgtggcggatggtcgtgatacttcgtcacgctcgcaacacgtcttacgttctatattatgacagttttcagactgattttcaaaatctgttcacgaattttaacgatcatcacgctattatttgataaacgcgatcagttgaccgggcatggtatcttttagccactaagtatgcaactgctacgccatactgccaatggctgttattcaccgtactactcagccgtaagagtaaatcgtcgtttttccaatctacttaataaaaatataattatgtaaactaaatcagccgaaccaagttcaactccagcattaccctgctttaacaaaaaagtggtaagtagctttgaaacactacttaccaccactaattattatgcagcgggcacaatcgccaaggtccaagtaataatgctttgatactcaccaggcgttgccaatggtgttgctggtaactgtaatgaactaggtgccacatcaaaagtttgactctgatgaccagtttgccggtaaacgctggttgtcgaaccatccgttggtatcgtttgattgagcactcccgtcgagtctttgagcattaaccgagccgtcttgattgttgtatttccagcagtaaagggactcagactcgccattaactgccagtcagccccaacagtccggtcatcaaccacggccaaccgatagtcattattaccgtcataaccgtcattagctttgacggccgtcgggtctgtcgccaagtcagtaccttgtgcgagtcgctgcaggtttaacgttccaaaattaaaattaggaacggcactcaatgataaccgcccaccactcttaactgttagcaaagcggcgttggtcgtcactgtctgtggcttgccattgaccggatagcttagactcgcatagtaggccgttccatcatcatccgcattggtcggtaccttgaccgtataactcgtatccgtgacattgagggctgtagccttaccattcttgacacgataccaattgctaacagtcaccccctcgggcaatgctggtaatgtaaatgttgccggcgtcccttctacgaccgtcacatcttgtaacgctccaaccaaaattttgacgctatcactcagaccattagaggttccggtaatcgtgacagttccgtgatcatccgcttttccggaattatccgtggcggcatccgctgcggtcacattcccatattcatcaactgccgcaagtgacgggtcactactcttccaagtaattggatccattgcttcctctggcgtcagtgctgcatgtaccatggtcgtttgtgcattattgagccacacgtcatcactcgtcactttgatgccagtcgttaccacccgggctggcgtgaccgtcactttcgcgattttggaccaataatcaggaaacgccccaacaccagagaaatcatactggacttgaaaataaagatgcgttgttttggtcacttgcggcgcattgaaagtataggttcgactattagtgccaatcttctgataggtttgcccctcatccgtcgattcccaccaaacgtacttgcgaccactcaacagacttgtcgccgcctcaagcgcactgcgctgggcccgaaccgacagcgttactgagttgccaccaatcacatttgaatcgattggctgttgtgaaaaaccgcccgatagattcaagcctaagacggaactcggtggactgcttggcgattggggcgccgttttggctgctaaggcactcgtgacgatacctaaaccaaccagcatacttatcaccattaggccacaagccttgatcaactttctcatcgttcctcactccttacgcgaacgccgctggccaaaccagtacgccgccattagaagtgctaagagaatgactagtgccactgcaccccacagccaccagttgacctgacgcggtccaaccagatgatgattatgttgttgcgcccgttctgcagtcaaggtaaagtcacgggtgaaatcccagacacgctggccgctcgttagatgcaattttagtcggtacttccctgcggctaagttttgcgtgcccaacgcgacttgatagttaaaccagctattcggtgccattgatcctgatttaagttgctgcgtggcaacggtttttcccgtcgtgcgttgaataacgcgtgcttgaattttgagttgtccaaaaagtgtcggcgtcagattacggagtttggcaaagagtactggttgcccattggtgggcgtcactttgacttcatcgaggactaacttaactggaatcgtcacttgcggctgacaccaaagcgccaccgctgtaacctctgcatagcgattcttcaacataaaaccttgactcgtcgttggccgggccgcattggcggttggattggtgacaaagaggccacctaacacctccccttggaacccagacttgggaatcgtggtcttaaaagccaccgttttcgcttgatgagccgctaacttaactacgacgccacttgacgtcatgtcagtaaacgtcgtcgtggcagatgggtcatgccgcttagacggcacgtacgcgacgctgcctgcatctgaggtcgttgcgttgaccggtgttacctgcaacgtaattgctgatttactaggattgctgacggagactctgaacgttgacgtcgttcccggcgtgaccttcatattaaagtaacccgcctgcttatctagttgatccttgggcagtaggggtgtcagaataaaacccgatgcgggtgtgttagacgccgcttgaccaggtaatgaccctaaaagcccgcctagtagcaatgccaacactaataaccaccactgaccgatttgtttccatcgcattctaaacacccccacttcacttaatcattgaataacgacgcgcgatgatcagctgaacctatgaagctgcttttggtgttgctgcagctgctgctggtgcattttgaagcgtccagtaaagtgttgctgtgtaagttccagcagaaatattggactgcttaccgacttgcaatgaactgctcgtggcagtcgtcgctgtgtttgaaccttcaccactatctgcagcagcattccataacgtttgtgggctcgcgacccatccgtttgtcacttcgctctgattcaaactcaatgcggtcggcgcggcagtattagcattgtcagcgttacccttggtcatattcaaattcaatgtggccgagtcaactttagccgctcccgaactaaacggtcccatcccaactgtcaacgtccagccagcatgatttccccgaaagtcgctaacgtttaaattgccactaccattgccatcatagccactgcctcccgacgtattgctacttgttgcatttaacgttgtggcagccgatgcaatattcttaacgttggtcgaacttaacgcgatatttggcacagcatccaacgttaattcaccgggcataaccgtaaattgtgcattcgataacgcttccgcattacccgtgctatccgcaacataaccagacgaaactgtcgtcaaattgttgcttgctgttccgggtccggccgctaacgccgctaggggcattagcgcaagtgatagtaaagttgcgccaccactcaacccggtcattaatttaaaagttcgcatgttgcttcctccttctcaatcgactgcttttccagtcgcctgctaccatattagtttactaatcactttatgattccgctttcaccgtcctcttcccctgacgccaaccatagtttatcatgtataccaatcgaaactgtgggttatgttttgattcattaactttccatattaattaaacgcccggtgataaccggccacaacgtggatacccagtcacccttgtaaccaaaaaaacatcaaggcccgttgtccttgatgtttttacatcattaattcatttatttttttaacgcttcatctaacgcaataacgcccttaactggaccaaccacagtaatcacatcatggagggccatcatatccgtcggcttgggcgagacatcaatgtgtttctcgtgtttgattgcaattaccgtcagaccaaaacgttgccggatctttaaatcgatcagattctgattaacaaagttcggatccgtaatctcgattgcggccaacgtatactcatcacttaagtcaataaagtttaaaatatggttggaaaggatgcggtgggcaatgccctgacccatatcacgttccggaaatacgacttggtcagcgccgacccgttcaaggacccgcccctggtcgctagtttcggccttggcgatgacctttttcgccccctgctccttgctcaacatcgtcgtcagaatactggcttccatattattgccaatcccaataatcacataatcaaacgtatcgacgttcaaatcacgcaacacctgctcgtcacgggtatcagcaatcattgtctgtgtcgccacgtccattagctcgttaactggttcttcgttaatatcaacggccaaaacatcctgatgagctgcggcaagtgcccgaacaacactctcaccaaaccgtcctagaccaaatacagcaaaactttttcgcatgttgcccacctaaccaatcaaaatattttctgccggataacggatcaagttcaccctagcttgacgtctggaaagcgcgtagagtgacgtgaagatccccacccggccaataaacattagcatcatgattacaatcttcccaatcaaagtcagattgggcgtcaatcccaaactgagtccgacggttccaaatgctgataacacttcaaacaaaacgtattccaacccgaagcccttcggaattttttcagtctgcgttaagatcagtgttgccactgtcagcacaatactagccaagaaaatcagcattagcgcccgattgatattctcctgactaaaacgacgatgactaaactcaacatcacggcgaccacgtagctgggcaatactttggaacatcaaaacgccaaacgttgtcgtcttgatcccacccgcagtcgatccaggcgtcccaccaacgaacatcagaatcataatgaccaataaactccccgcttgcaatccttgagtaggcattgtgattaaacccgctgtccggggggtaacacttaaaaacagcgtattgatcgttcggttgacccacgacattccggttggcaacagttccaagtcacgttcagtgatcaacaacaagacaaaaccgatgacaaataaactgaaagttgtgagtaaggtcagtttggaatttaaagtcagtcgcttacgcgtatggtacagcagcacgtcacgccaaactaaaaatccaaggccacccgcaataattaggatcatcgtgaccgtcaagacgtatggatcattacgaaagccttgcagactatcgccaaacacatcaaaaccggcattacaaaatgacataaccgcatggtatagtgacacatacaatccgtgacgccaaccaaatcgaggtacaaaatcaattgcgagcaacccaagaccgcctagctgaaagagcagtgacaaacccacgacatacttcataacgcttttagtatcactcaatcgttccaaattcagggaggccttgaccatcaactgcgtagagagaccgatctgacgacgcataatattaaagaggagtaccgcaaaggtcatgtagcccagcgcaccgacctccgaaagtaccagaatcaccaattgaccaaacgttgtccagtgcgcagcagtattgacgacggtcagcccagtaatacatgtcgctgatgccgacgtaaacaacacatcgatcaacgacgtgtgcacgtttgctggcgtcgcccatgggaggctcagtaagactgtcccaatcagaattaagataataaaaccggctaccattttcttagatagcgtatcaaaaaatttaaaatgtgctaattgtctcataatcattccatcccacaacagcttatcgattataaccaatcagtccgattgatcatactccatttagcttaatcaacctagccaagaaaagcaagtccgacctaagctttgacgtacgccggccacggccgacccaatacatacaaaaaaaccgctaatcaagctcagcttgatcagcggtaaaccaattacgaactaaacatactgtaagacgcgctcatcattataagcagcgtcaatcataccggaacctaagcattcctcaccgttgtagaagacaacggcctgtccaggagtaatcgcccgaactggatcatcaaaagtcacggtaacttccgtgtggtcatcattaaaatgcaccgtcacaccagaatctttttgccggtaacggaactttgccgtcacgtggaagtcattacctaagtcttcatcagtcacaaagtgtaaatcggacgcctttaagtgggtcgcgtacaggtgcggattatggtagcccttgccaacatacagaatattcttcttcaaatctttgccgaccacgaaccatggctcgttatcctcgccatcaccaccgataccaagtccgcggcgctggccgatcgtgtaatacatcagcccggcgtgctcacccttcacctgaccatcgaaagtcatcatcttaccgggcgttgctggtaagtaatggcctaggaattccttgaagttcttttcgccaatgaagcagatcccaacggagtccttcttcttagctgttgccaagcccgcgtttaaagcaagcttacgaacgtcaggcttcaccatttcgccaagtgggaacatcaccttttgtaaggtcttcgaatccagctgacttaagaaataagtttggtccttgttgctgtcaacaccacgcaaaaggtgcatcgtgccatcttcatcatgttgtaaccgcgcgtaatgaccagtggcaatgtaatccgcccctaaatccatcgcgtaatctaaaaacgccttaaacttaatttctttgttgcagataacatcggggttcggtgtgcggcccttcttgtattcgtctaagaagtacgtgaagacccggtcccaatattccttctcgaagttaatcgagtaataaggaatcccaattttatctgccactttggcaacatctttataatcttcggtcgcggtacagacaccattttcgtccgtatcgtcccaattcttcataaacacgcccaccacgtcataaccttgctgcttcaagagcaacgccactacggatgaatcaacaccaccactcatgccgacaacgacacgcgtgttactgtgatcagtcatacttttcaccatcatttccaaaagattctggagaatccacgatttgaaggtcgtacaagtccagtaagttccattataacaaagaaaacgccggctgcaagccaggcgttccctgattagtccgtcgtgaggacatcccgttcaataaagttagctaaaatataccgtaattgttcaacagcttccggatgggcgtcatttttgaaaatatttgcccgttggacaccattgcccgttaccgtcgtcatcttaaacccagtcaaatccgcattgactgtcatcttcagcttgaaagccgcttgatagggtgaagtgggatccaaggaacgttcaaaactaaacgcgcccgagcgacccttcacaaaacccaaatccatcaacgtgtatttcttgaccgttggactcagcgtatacgtcttagtatccccatctagtttaaccgttgttgtgtatgccatcgtcacgccccctgcttttttaataagcgctgcgtcgtcttcgtcagcaccgttacaaactgatccagatcagccttagtagtatagcgaccaaagctcaaccgaatcgactcgctgatccggggagagtcttcaccatacattgcaattaaaacgtgtgatggttctaggctccccgccgtacatgcggagcccccagaaactgcgacaccacctaagtccaggttagtttgcattgtataggtcgatacccctttgatccataagttcaaaacgtgttgcaagttatgctcaccgagggacccgttgacttcaaaatcaactccgttagccgttaactggtcaacgatgtattgcttgaactcacgatacttagcctgccggtgggctttctcagcggtcgtcagttcttgcacggccgtggcaaagcccgcgattgccgggatattttcagtaccggcacggcgcttatcttcctgttcgccacccttgacaaagctaggaaagttaatgccattgcgtctgtacaagaagcccaagaatttaggcccattgattttatgtgctgaggtggacaacatgtcaatatgatcccgttgcacatcaatatccaacaacccgtaggcctgcactgcatccgtatggaaccatgcctggtgatcctttaacaattcaccaatttcatggattggcatctgtgaaccaacttcattattcccggtcatgattgagacgagaatcgtatcaggacgtagtgccgccttcaaatcatccagactaatttgtccctgttcattcacgggtaaataagtaatctcaaacccatgttctgccaaaaaagcagtcgatttaagaatcgcttgatgttcgattgccgtcgtaataatatgcttgcctaaatgttggcgcgtccacgcggtctgcatcaccgccgtattatcactttctgtaccaccactggtaaagataatgtcatcgtcagctgcgttaatgctttgggcaatcacgtgccgactatcgtctaaaacttcacgggcggcccgaccgaatgcgtgggtgcttgaggcattgccaaacgtattcgtcatttgatccgtcatcgtctgaataacggacgctgccattggggtcgttgccgcattgtctaggtacacttgcttcattacatcatacttccttctaaataattcttagttattagcatcactgcgatacatctgactaattttgcgccgcaaataatgcaagtaacatcgctgcggactgcttacccgcttccaggataaattcgtcaaaactaacaccggcattttcatcaccgacatcggacatcgcgcgaatcaccacatatggcgtctggaactggtgacaagcttgaccaattgcggcgccctccatttcactagatagtgcttctggaaagtgtgctaaaatcttatcggtagccgccttacctgcgataaattggtcaccggaaacaatcagtccagtcttggcattcaaaccggttgccttggccgccgccatgatttgctttacccaattggcatccgtttcgtagtatagtggctgttgtggtaattggccatattcgtagtcaaaggccgtcgcatcaacatcgtgataagcagttgccttagctacgacaacgtcaccgacatgcaaaccagcgccaatcccacctgcagaaccagagttgatgacaacgtccacatcaaagttagtaatcattaaagccatagtcataccagcttgcactttaccaatgcctgattgcactaagacaacttcctgctgatcaattgtcccatcatagaacgtaatatccttaatattaacgatcttttcgtcttgcaaagcgtcccgtaacgttttaagttcttcttccatcgcacaaataattccaaatttcatgtgagcctagcgcctactttctatggtgttaaaaataaaattaaaaagacaataataatcccaacgactagtccagcaatcgcccaattcaatttgcgggctagccgtttcgtcttggcttcttcaacagcccggttgttctcagcagcatacgcttgtctggatgcactgggttcggccgttggtgattcttgctcctgagtatcgtgaccagttggctggctacgttgttgtcgatattgctgtctggtgagtcgatcatcatctgccactatgcttcaactcctaactcagggtgactttgccagtaccaaatcgccattacggttttggcatcctgaatctgaccagtctgaacttgactgacagccgtcgcgaggtccagcttgatgagcctaatttgttcgtcagggtcttgtgggaatgccgttgcaaccgcactcagaccggtagcaacgtacaacttcattagttcgtccgtaaacccgggtgacgtgtagaattgggcgactgcttctaagtgctgagctgtcaatcgtgtttcctcatttaattcgcggacggccgcctggtccatggtctcaccggattcgaccttaccagctggaatctcgacggtcagcccaccggttgcagcgcgccactgttgttcaacaatcattttatgttgcgcggtaatcatcagcatcgcgacggccggctggtgtcgcacaatttcacgtgttgccgtcgtttgatctggtaaagtgacttcttgtcgttcgacctgtaccaacccgccttgataaaccaactgacgactctgaacccgttcctcaaatgtcattgatcaagaacccctttcagtgtctgctctctcaataaggataccgattttttagctcgattgcaattttcaactgggcgatttcggtaattttaacgaacccgcaaaaaatgggctaacgagcgaccaatttggctccttaacccatttttccaattcttaaaatcaagcggaccaattgacactaatcgccattaggcctttgcaaggttagcgacgaaatcttcataagcaacctgctcaccagtttccgttgctgtagctgggctgtagtcgccctgaagcgcatcttctaatggcaaagtcacgatccggacgaacgtcgcgttaccgatcaattccatccagtattcttcatcggcaccttggtgaacaacggttttgaccatcccaccaggattggtgacgtggatttcttgattaaaatcggtactttcttggtgtaataacacgtacatcaatgaggaagccgacatcgcagtcccacaagcattggtaaaaccaaccccgcgttcaaacgtgcgtacaaaaattgaatttggtcctaagacttccacaaaactaacgttgacgccatcagggaaaatttggtttttaccatcattcatccattcaccgatacgtcctaattcggggccaaccaacgtatcatggtcaacgaacgcaatcaaatgcggattaggcaccgccacagctgagaatttcaagtcagcagacagcgctggaatcttttcattaataattgtcgtcgcatcgttattcgcatacatgccaagtgtctgcgcgtcgaaagttacgggtgaaatttcaacactgtaagctgggacgtgggccgcaaaatcagcaacggcctgcacttttaagtccgcatacatcgtctgaacccggaagtcttcctgactattttgcgtgcccaaataacgagcaacggtccgtagcccattaccgcacatgctagcttccgtcccgtccgcattaatgacccgcatccgaccaagtacttgtggatgttctgatttatcaacaaccaacacgccatcagcgccatcgtacaaacctgcgccgtcacgtttacaaatgttaattgccaattgcttcaaatccgcatccgataacggtgcttgaaattgtgtttgatccaataaataaaaatcgttaccagaaccgtgtaccttgatcattttcacagccatcaacatcctatctatataaaatcgaccttaatttaaactacttcattatcatactgactttttcatgaaaattcaattgcaaaggaccatttctcataataaccattcaaagtcctgcgcagcaactgtaaattcttaatagctcttaaatcttgcatctgaaaaacgcaatcagttttttacagctgtatctcaatcatcccggtgttcggatttactgactacttgataatccccacacgccagcacaaaaaagtgccactaatcagtcccgttcgactgattagtggcacttttcataagttatcaagactcacgctaaatctaattcagattaagcttccaaaccagttgttactgattcagggtagttttcacgaacgattgcggcgcaccgtgcacataacatcggataagcctcgtcactgccaacatcggtcttaaccattcggcaacgatcacaaacgtcaccgtcagcatggccaaccttgatggctaacgtgtcaccaaatgtttctgcgtctgcaggcgcgtcacttaacgcgtgtagatctaatgctgaaaccatcaacatctgccgaacattggtattcagatggtctaagaaggcttgcgtatcatcatcaacatacaaatccaagtgtgcttccaaggatttaccaatcaacttagcatcccgggcttcttccaacgcctttaagacgttactccgaagatccatgaaccgcgtccattgagccatcaactcgtcgctgttcgcataattttgaacagctggcatctcagctaattgcgcaaattcttctggttccttcaagaatggccaaatttcttcagtcgtgtgtggcagcattggcgtgaagagcttcgtcaaggcaaccaaaacatcgtagaagaccgtttgcatcgaccgccgtgaatggctatcctcggcatcaatgtacataatatccttggcaatatcgagatagaagtttgataaatcaaccgtcaagaagttgatcaacttcttgtagatatccaagaaatcataatgatcgtaatggtccttcgtctcagctacgaattcgttcaaccgtgtttccatgtactggtccacacttgctaaatcttcataagccacgcggttggtcttcggatcaaagtctgcggtgttgcctaacatgaagcgtaccgtattccggaacttcttgtaggaatcggctacttgcttaaagctttccattgagacccgaacgtcggaactggtatccactgaagcgacccacatccgaacgatttcagcacccatctgcttaataacatcagctggcgcaatcgtgttgcccagtgacttactcatcttacgaccttgattatccaacgtgaaaccttgtgacaagacttgcttgtatggggcatgtccagaaacagccacactcgtaatcaagcttgagttgaaccaaccacgatattggtcagaaccttcaaggtataagtcggctggatagtcgaggtatgagcgctctgccaggacaccttggtgtgatgaaccagagtcgaaccaaacatccataatatcggtttccttagtaaaggtaccgtttggtgaatgttcattggtataaccatctggcaataggtcctttgcgtcgcgttcgaaccaaacattcgaaccatacttgccaaataaatcagctacgtggttaatcgtcacttcgtccatgatggcagtgccatcttcagcatagaagattggaagaggtacaccccaaactcgttgccgtgaaatgacccagtcaccacgatcacgaatcatgttgtaaagacgctttttaccccactctgggaagaattcaacgtcatccatcgacttaaggatttcatcacgcatatcaccaacggaagcaaaccactgtggcgttgcccggaagataatcggcttcttagtccgccagtcaaatggatagctgtgttcgtatggcatatatttcagtaataacccagcggccttcaacttgtccagtgcgatcttgttagcgtcatcgtagaagacccccgcaaaatcatcaccagcttcagccgttaagaaccctttgtcatctacgggagcaaagattggcaggtcgtattgcttaccgatccggtagtcatcttccccataaccaggcgcagtatgcactagcccagtcccagaatcaagtgtgacaaaatcacctaacatcgttactaaatgccgactattgtcaaaaggatgttcgcacaaaatgttttcgagttccgcacccttgaccgttttaagcacttgaacatcttcccaaccaaatcgttcggcattttcgtccaacaattcagccgcgagcacaaacttacgattttcaccagccggttgcacaacgacgtaatcaaaacttgcatcgattgtgattccttctgaagctggaatcgtccaaggagttgttgtccaaacaaccatataggtatcatcatctaagacacccttaccatcaatgacatgttcaccgtagaaggcggatggcgatgtcacatcatgatattccacttcagcttctgccaaagccgattcagaagaccatgaccagaagacaggcttttggccccggtagatcaagtgacgtttagcaaacgcaccaaagacccgcacttgagccgcttcaaattctggctttaacgttaagtatgggttgtcccattcaccagcaacgcctaagcgcttaaactcatcacgttgacgatcaacttgttccaacgcgtatttccgacaaagttctcggaattcattgtccgtcatcttcttgcggtcataaccggcttgctttaacttctgttcgattggtagcccatgggtatcccaaccaggaacgtaaggtgcccgaaacccattcatcgacttatagcgaacgatgaaatccttcgtgatcttatttaaggcgtgccccatatggatatcaccattcgcgtatggtgggccatcgtgtaagataaagcttggcttaccttcattcaatttttgccgttgttcgtagactttattttcagcccacacattttgccgttcaacttctttgaccggtaagtttccacgcattttaaacttggtcttaccgaggtttaacgtttctttaacgcgcatattctcactccttaaaatttttatcaaacaatcgccattggatttttagacacaaaaaaacttcgtccacccagggacgaagttatcgtggtaccacccaattttagaattgtttaaattctctcttagcatggttaacgtccatggaccggccacccttactcaattcaggatagcattcggagatgatctgcaactaactaagggacgactgcctttccattgccggcagctctctgggcgtattagttaattgtttgctgttctcctcaatacattcaattcgcttcaattgtgcctgacgatcgcctaattaattattagtgttgtcatcatcagggaaaataaccaccgtctgttgttggacttgatcgccaccgtccgcaacgggggtctcaccactcgttgcttccgtaatttcaacggttgcttctgagtttacgctcgcatcccccgaattgtcaaggttatcttcctttaaaacgtgttgaatttcagcataatcagccgtattcgtttcgctaagtagttgatcccaatccttgctcttaaccacttctaactgcgattctaacatcacttgcaagcgttgccggaagacccgcgtttgtttcttcaaatcatcagtttcaacggataatcgtttggccttttgagaagcttcgtcgatcatttggtttgacttgtcggttgcttcactcacaatgtcagacgcttgtttctgagcttcgcgggtgataatgtcggcttccttcttagagttcgtcttcactttatcagcagcttcttgagccaccaagatagattgattcaaggaatctttcaattcattgaaatacttcaacttaccttcactcgagtccaaccgttcttggaggtctttattttgcttcaaggtaatttgataatctttgataatttgttctagaaaatcattaacctcatcaatattgtaaccacgcagtttcgttgaaaactctttgttatgaatgtcatcaggacttaacaccattagaattcctccaatatctatttactatgaataatatttaatgttattcgcagccgcgcttttttggtctcaccgctaatttcggcaagtcggacacgaccgtaatggttcacactcagcatatctaacaatgctagctcgtaatcagctttcggtaagtcagcccaattcagccgaaccttagcaccttcgatcaattccttggcgtgatgccgcgacaagttgaacgccgccttaatgatactatccgcacgtaatgaactaaccgtcgtagtaactgcctcccagtcgtcttccggtgtgatcaccgccgacaatggtaccgctgttaagtggactttcgtcttaccaaaacggtcgatttgctcctcgaaatagctggccatctcggtttcgcacacaaactgccatgtcgttccgtcagtcacgatgtcaccaaagacatcacgctcgacgccggcattggcaagcgtacccagaatttgaccatgctttaaggtggcaaacttcacgggataaacaatgttaaacagtgtgatttgaaaatcggccacttcaggttcgtaatacaccgggtaaaataagatccgttgtaactcagcaccttcaaagccaccggatgcccgcatccgcacgtcgtctaactggttgaccagcgtttgcgcaatgtagatttgtcgcgggttcaaaaacgcagttaagattggtcggtactgatcagctacttgccgtagccaaccagtgacctgctcaataaatggggcttcactatcgcgaaaatgttgttttaagttatcattcacgatactatcctcgttattttaatttagtatatcaataaagttatcagataaaataggccactttcagctaattggagcactaacagcgcaataatcggtgaaaaatccagtccggcaattgcgggaataaagcgccgaaaaatactgagaaatggttcacagatttgacctaagaattggcccacgcgagtattataagctcccgggaaccatgacatcaaaatgtaaaccacaatggctaattggtacagttgaaacaaccgactaataatcgtcactaacaggccactcactccttataatttgctcgtatcaaactgacttgtcgtacttccggaaacctcgtaattttcaggaatacagaggaaaatttcatcaccgatccgttcgatctcaccattgatggcaaaaaccgtcccggtcaaaaaatccacaatccggcgtgccatttcatcatcgacgtgatcaaaattaatgattacagcttgatttttcaataactgcgtcgcaatttctttcacgtccgaataaattttcggttcgaatagggcaattttgctattcaccgacttgcccccttgcattggaactacctttggcgtgctccgagtattggttgcagattcagtgggagccgccgcttgggaagcttcggtgggttcctcatactgactgtcagaatcaccaacaccaaaaaagttactaatgaatccggccatgtgcttgcgctcccttcaccgttttacttacgccggcgcttgaagaatggtggtgtatctagcgaatcaccactgttatcatccttactatcgtcagcttgtgagttgtcattaaagacatcaaaatcagttttttcaacattgttaaactcttgaccattgttgactggccgtgaattgttcggttcgcgccgaatatcccaattaccgaatgggtcgttagcttgggactcacttgattgggccgcttcactcgtcgctggctggtcagttggcgttgcgaacatgccgcctcgttgctgactagcttcactacgactaggctggctgtccatcttgagttcgcgttgcttctgatcgataccagtggcaatcacggtcacccggacttcatcgccaagactttcatcgatcgaagtcccaaagataatgttaacatcagtcgttgccgcttgggaaacaatgtcagaagcagcttgggcttcatacaaggacatgtcggggccacccgtgatgttcagcaagacttgttcggcaccatcgattgaaacttccaataatggtgaagaaatggcttgtttagtcgcgtccgccgtccggttttcaccactagcagagccaatacccatcagagcggaaccttggttttgcatgaccgtcttaacgtcggcaaagtccaagttaacgtaccctggtgacgtgattaagtcagagataccttgaaccccttgacgtaacacattatcagcttcttggaaggcttccatcattggagtcttcttatcaacgatttcaagcaaacggttgttagcaataatgatcaacgtatcaacgttgtctttcatctgagcaattccttcagcagcgttacgagcacgcttaggaccttcaaatgtaaatggacgggtgacaacacccactgtcagcgcgccggagtccttagcaattttagccacaactggtgccgcaccattaccagtaccgccacccataccggccgttacaaagaccatatctgagccttgtaacgcttctgtcaaggcctcttcactttcctgcgcagccttggaaccaacatcaggattagaacctgcgcctaatccccgcgtaagctttggtccaagttgaattttagtttcggcatttgaagtttgtaatgcctgcacatcagtgttggcaacgatgaattcgacgcctttaacatcttcagcaatcatccggttaacggcgttaccaccaccgccaccgacaccgatgactttaatattagcccctgagttctgggttgaatctaaagaaaattccatgttttttcctccgtcatttctatccgatattaatcaaagaagtggttgaagaagcctttgacccgttcaacagttcccttatgatctggatcagcctgttcctgtggtgcttgtggcgcagactgtttcttagttgcttttttaggttgtgctgcgggttggctaggtgctggtgttgtatcagcaaattccaacgccacactggcacgagtatcaccggtaagtgcactcttaacgagtaacgtaacttcactcaaggccgcttgatatttgatgaccgctaacgcctcatcaaacgacggatgcctcaagcccatttgattaggcgtaaagacgcgaactcgcgttccaaaacgttgcgccgccaaatcagtgataccgggtaatgctgccaccccaccagttaaaacaatgccaccggggagctcgagcgcccgaatctcatccaagtgctgcttgaccttatcaaagatctggtctagacgagcctcaatgatttctgctaagtattgctcacttatttgctccggtgtactttgcccaacaacatcaactgggaaaagttcatcatccgaggcctgctgagcatcggcatagccataatcacgctttaacttctcggcattctcgatcgatgtattcaaaacgaccgagatatctttggtaatatactggccgccttcttggtcaacgtaagtatacttcaattggtgatcatgtataactgccgcagtcgtttgaccaccgcccatgtcaataatgatcgaaccaaaatcttgttcaccgtcattcagcactaaggaacttaatgccaagggcgcgatcacaatctgttcaatttgcagtccagccttttccaaagccttccgcgtattgtgaatgattgttttcggaccagtgaacagggtgccgtgcatttcaagccggaccccaaccatgccacgtgggtccttgatgccatcaaaaccatcgacgacaaattcatcggggatgacatccagtacttcccgctctggcggtaaactctgaactaacgcagccgccgcaacgttttgaacatcttcattattaatttctttggactcatctgccacggcaatcataccacgacagcgttcaattttaaccaggttagcgggaactcccgcaatcaccttttttatttcgatacttgctttttcttcagcttggcgtactgctgatcgaatcgtttcggccgccttatcaatatcgacgatcacgccacgacttaaaccattagaacgtgcgcttcccacaccaataacgttcatttgccctttaacacgttcagcaacaatgacttttattgaggtggtccctatatcaagtccgacataaattcctgaattatccataatagaggaacctcctagtattttacataaatattcaaggattcgctgacatatccagttattccttagtttaccatatcctaagcgcttttaaaaaggtcacacttagcattctatcaattattctgattcttgaacggataggagtatgcgcccacctcaagattgatgacacccttggttttcatcttcgccacaatccccggataataagccatcttgctagcaaaagtgctaattgttgcgtacacttcattaccgtcattcatgtaaagatgaacccgttcgggattagccttgttcggcgcaaacttgatctcagaaatattgtgtttgaccgccgatggtaacttagcgtactgtgcaatcatcgttgctaagcggtgaccgcttttaaagttggcatagatcggtgaaccgccaccgggttgagaataggtcgctttcaaaatcaacccattttccaaaattcgtcgatagtgttgaccagtcgataagtaacccgcgatgcgaatttctttaactgtcacccgaacactgttcaatccaactaacttagtcgtgaccttgccgatttgcggctgggcacgttctgcgcgcttagtagtccgttgatcatgaccaatcacggaccataaggcaactccagggttgatcttagtcgccgtcttgacctgcgtaacagacaattgatcgttaccatgtacggtcaccgtctgaacatggctcagtggtgaaatgaagtaaccagccacaccagcaccgatcagaaaacagcccatcaagatcacgacccgtttgaaaagtaatcggcggcgctgagatttgagtttcggtaatttatcgccaattcgcaggcgtttacctgaccaactatggtgactcttttgcgctgcgcgatgattctcagccgcgtctcgttgaaaccgttcccagggtgtcagctgctcggggtgctcacgctccttgggctttttatgaaaaatggccatcacacccaccctttcactctagtctctgtgctacttaatcaccgtttctaaaacgtgtagtaactggtcggccgcatcaggcatccccagttttttcgcattagccgccatcgtttcacgatgcgtggtaccttggagaaggccatctaatgcagctaccaaactggttcccgtcaaatcagcttccttaatcagttcagccgcccccgcattcacgaggctttgtgcattcttggtctgatgatcattcgtaacgtatggactagggactagaattgaaggaatccctaaagccgtaatttccgcaatactagttgcacctgctcgaccaagaataaccgcgacttctggtagaattgctggcatatttttgatgtatggttcgattttaacattcggagctagcgctgtcgctgacaagccattccgaatcttttcgtagtgtacctggccggtgacgaacaaggtctgatagtcacgtttgttcagttcaggaattgccgcgaccgctgctgcgttaatgcgcgcagcaccccggctccccccaaaaatcaacgccgttggaatgtcaggatccagatcaaactgcgccaaagcgccactttttttaatattagccacttgttgggctcgaggattcccagtcatcacaactttttgagcgggaaattgtgagcgcgcactctcaaatgaaatggcgattttatccacaaaccgacttaggaatttgttagtgacaccaacaactgaattctgttcatgaatgaccgttggaatgtgcatctggctcgccgcgaaaacgaccgcaccactcacgtagcccccggttccgaccacaacatctggtttaaacgccttaatgtacttacgcgccgtaaccacactctttaaaaacaaatagactgttttaacattttgtaatgacaatgaacgcttaaagccctggatcttgattgttttaaaatcgatcctccgttccggcacaatgcggctctctagtccacgatgggttcccacaaactgaacttgcgcttcgggatcatgtgcttttaaggcatcgatcagtgccagtgcgggatagatatgaccacctgtcccaccgccagaaatcattaatcgcattagttttcttccgcctttccagttaactgttcgattgctttaataaatcggtcgccccgcacttcgaagttcgggtactgatcccaactggcacaagccggcgataacatgatgatgtcaccagcctgactatgttgccaagcaattggcacagcagtctcacagttgtccgtaaactcaatatcttgaataccagccaaacgcccagcgtccgccattttttcagcagtctcaccgaagacgattaacgtcttgacatgcgcctttaatgcgggagcaagcttttcaaacgtattaccacggtccaaaccaccagcaagtaaaatgaccggctgatcaaagcccttcaaggccatctcggtcgacaccaagttggttgctttggaatcgttgtaaaattgccggtcctgatacgtctcgacatattgagtccggtgtcgaacacccgtaaacgtcttcaagacttgaacgattcctgctgttggaacggcttgaagtttagcaacagcaatcgctgctaacgcattttcaacattatgatcaccaggaatccggatatcagcagcatccatgatgtactcatctttaaagtacagcttgccggcctcttcataggcgccatctttcgtattggcttgccgtgaaaatggcacgacggttgcttgtgattgcttactgagttgccgccattcttcactatcccaattaatgactagataatcattagccgtttggttcatggtgattcgcatctttgccttgacatagttctcacgtgagccatggtaatccaaatgcgtcgaataaatattcgtaatcaccgcaatatgtgggtgcaaagtttgaataccacacaacataaaactcgaaagctcagtcaccattgtgtcggccgccgtagccttttgtgcaattgctgaggccggcacgccaatattacctgccacgtaagctttaccggcatttgtgcgttgattaagcatcatcgtgatcatcgtcgttgtcgtggttttaccgttcgtccccgtcacaccaatcaactctcccgctaggatttgcgatgcaagctcaacttcggtaatgactggaatacccttttcctgagccccactcacaattggatttgagtatggaatacccgggttcttgacaacaactttaaaatcttcatctagtagtgacagcgggtgaccacccgtgataactttgattccatcactcaataattcctgtgcatccgggttctcatcaaatttctttttatcattaacggtcacaaacgcacctaatttgtggagcaaccgtgcggcattgaccccgctctttgctaatccaagaaccaaaaccttttggttacgatactgctcaaccgacttcataaaccaagatctccctataatgtttgtagatgatacctaaattaacttgttatgtggctgatgcaccaactcgtggtcatcagcaaattattcatggtgagccagtgaccaattccacgacataatctgcggcagacaacgcaaccatttaaagaacaatcgttgcgttgataggaatcagtactatttacttgtcacttacttggcgaccaccaatgaataaagtcataccgcaaagaccaattatgtacagctaactcggacaagaatgcccgagttagcaaactgtgactaaataatcgtggcaacactgattacggctgccactaaaccaatcgaccaaaaaacgatatcaatcttccactcgctccaacccttcatctcaaagtgatggtgaattggactcatcagaaagatccgttttcccgttaacttgaacgaggcgacttggaggataactgaagccgtttcaatgacaaaaatgatgccaatcaagaggagggatagttcatgatgcaataagatcgatactgcagctaaagcaccaccgagcgctaatgatcccatgtcacccataaagatcttggccggtttgtgattatacacgaagaaacctaatagtgaccccacgacggccaaacagaataacatcacattatactgattttgagcgtaagcaatcacggcatacgcaccaaaggcaatcgtggcctgaccagcgactaatccgtccaacccatccgttaagttgacggcatttgagaagcccactaaccagatgatggcgaagagcatgtaccaaattcccagcgaccagacccccaagcctggaattctaagtgccattggcaaatgttcatgttgatagaccaacgttaaaattactgccccaatgacttgaccaagtaatttttgccaagcctttaaaccttcgttttgtttacgccaaagcttgatactatcatcccaaaaaccaagtgcaccgtataagaccaggataaacatcaaaatccaggtggttggttgtagctgatgttgccacccaccgacccataacgtggtgactaagattgcgataatgaacagtaggccccccatagttggcgtcccagattttttctcatgccacttaggaccttcctcacgaatcatctgtccttctttgcgggcgcggaaataccgaataagtgacggcattaacgcaaacacaataataaaaccactaattagggttgcaccccacactaataaactcacaacaattctccattctaagacttgataactacttcagtgtcacactaattgcctgcttagcttcgatcggattacccgcagtcacactttgcgtcttgacgtaacccgtcccgctagtcgtgagcttaacgcccgttaacgtcgcaaaatcagccacttcacttgccgaccatccagataagttcggcatatacatctgcccgttggtaaccagaatgacgcgttgaccacttgaaacgacagtgccagaagaaatggattgcttgacgacccgactacccttaccaacaacgaccacgtcaagtccctgcttcttagcagctttcttggccgcgctagtcgacttactcgtcaaatctttcattttgatcgtcgtcgctttagtctcactcgctttttgttcttccaatgcccgtttcatcacggtatcaaaaatctctgccatgtcatccgacgcggaacttccgttaagtgtcggttgtttcatcgtaatgtacataatgtacttcggatttttagctggcgccatcccgacgaccgagtacagataggtgttgtcaccttgctcatacgtactcccgttgctgacctgggcagtcccagtcttagcagcaatgcgatacccgctgatcttatatgatgagccagtaccgtatgacttatataccacatcttgcatatgatccaacaccttgctggcggtcttcgaactaattggctggcttacaaccttcttcttacccgtataaaccgttttgttggtgttggggttagtgatcttggagataaagtacggctgtaacatcttaccatgattagcaatcgctgtgaatccacgaagcatctgcatagcggtcacctgaatcccctgaccaaaggccgtatccgcttgttcgatcggatacgtgaattgaatcgaaccactctgctcgttgtcaagaccactattagtactctcacgcaacccaaagcgtttaatgtacttcagccaagtcttggcccccattgcttgttctaggtgggccatcgccgtgttacttgaaagggcaaaccccttagcataggtaatattgccccacccgctcgtattccaatcaggaacggtattattaccgatcttatattcaccggttgggacggttacattagcattgtacttaccgctgtcgatcgccgctgccattgtaaagaccttcatcgtcgatcctggttcatacgtgtcttcaaccaacaaattacgccacattttagatagtccggtctttgtttgcgcattaaatgtcggtcgctgcgtcgtcgccagaatggcaccagtcttcgcgttcatcaacgttgctgtcattgacttaggtgagaccttagcgtttacttgtgaaactttagtttccagtaatgtctgtaacttactatcgatggtggtataaatattatccccatccttaaccttcttaccagtctcagtgctaccttgatatccgctcttcgtaatcgtcttgcgaccatcggttcccgataactgcttgttaaaagccaactcgatgcccatcgaccccgttaaccgcgtctgatcggtatccttctgactcttggaggtggtcagcccaactaagtgggaagcaaacgtgccgtttgggtagagacgcgcttcagattcaataaagtgcagcccagccacattttgggcatcgatcttttccttggtcatcagtgaaatattcttaccagccgtcccaaattcaatttggaacttacctgcgcctttttgcaaggtcgcgagggctttcttatagctgattggcaaatacttcgataagacacgcgccgccttcgcattatttttaacatacagtgccttgccactagcactttgctgatttttcgccataatggcgtagaccgtgtacgtgctagtatcttcagcgattgggtcaccgttggccgtataaatagtcccacgtttggccgtgatggtctggtcttccgtataaagtttcttggtggcctcgaccagattgaccccgttgacgtggcgcacaatcgcgatatatgaaaaacgaatgatcaaaacaccaaagacggcaatcgcgccaaaaaatagccattggccaaaaattctacgattttgttttggtgaccgtttcgaagtcattcgttgtttgttcttattcatttgtaaacattccttatgctaccgttgttcagcgataacccgtactgcttagcaattttatttaaacggctccgacttgaaagttcactgatttcttgtgcggccgacgtattttttgcctgcacttttgtgactttcgtttgcaccgtctgtaactgactttgtgcgttactcgttgcaatgttcgttgaaactaacataatggctaatccaaacaccaccaaactcaaaccaacacacaatactttttcaaataatgaaaaagcaactcgctgcgtcttgatggacggattcggggtcacaacggtttttgttttatgtaccggggtggttgcgccaggagtttgctgtggcaactcccgcgctaatccattttgggccattttaatcactcctttaattattcctgaatattatttattcgttatctttaaacgttcgatggctcgtaacttggcgctgcgagcacgacgattagcttcgatttccgcatcgctaggcacgaccggtttacgactgactaagcggtaatctggttgcatttcagctgggataactggtaaaccaggtggcagctccggcaaatcgctgtgctccttaaagatcgtcttgacgagacgatcttctaacgattggaatgtgatgacactgacacgaccatgaacattgattaaatcaatcgcttgttcgagcgaagtctccagtacgcccaattcgttattcaccgcaattcgaatagcctggaaaacccgtttagcgggatgaccacccgttcgccgcgctcttgctggaatggcattcttaataatttcgaccaattgccccgtcgtcacgatcggctgaaccgcccgttcacgctcaatcaaccgtgcgacttgtttagaaaacttctcctcaccatagcgatagaaaatacgaaccaagtccgcatagggccaagtattgacaactgtttgagcagttaatttctgactctgatccatccgcatatctaacggcgcatcatgttgatacgagaagccgcgggcagcatcatcaaattgtggcgacgaaacgccgagatcataaactaccccgtcaacgtggtcaaggccccgagcatctagttcagtcttcaagttggcaaagttacttttgatgaacgtgacctgaccacgttcaagataagtcgctaagttactttggttataatcgattgcggtttgatcctggtcaaagctatacaagtggccttccggacctaactgttgcaaaatttcacgagaatgaccaccgccacctaacgtacagtccacgtagatgccatccggccggacgtttaacgcggcgattgcttcatgcaaaagtaccgttgtgtgttcaaatgttgccacgcgtgcgcccccttcctaaattattattgttatttaaaaatcaatcaagttttctgcaagatcatcgaagttcgctgcggtctccgtctcaaactgttgccagtgttcggcaccccagatttcaaatcggtcagaaactccgacgatcacacattgcttttccaactttgcatattgtctcaaggttgcaggtatcatgacccgtccctgtttgtctaattcacattcagcagcagcagcatagaaaaaacggacaaacgctcgcgcatccttgcgagttagtggtaaatcatctaactgtgcttgaagcgttgcccaccgttcagcgggatagccaaaaatacaaccatccatcccacgagtaatgacaaacgaagtgcccaatagctcacgaaacttggcaggaatgattagtcgccctttcgcatctaaggcatgttcaaactctccgaaaaacatcttagacgccacggccaatcaacccctttcattaaacataattcaagtctaccacacccccccacttcctaccacatcgttttgttacttttccaaattgttaacaaaatatcaaaaaaagtcccacctaacgttagtttcgttaggtgggacttagtgggggacatttttacgatgttaaaaagaagtggctgccaagtgctaggatatagacgacgagtgtcaataattccgctccccgccaatagagcttaaaaaagcgccagtaaaggatttctccgcgttcaacagcttcaatcagtgttaaaccgatccccaaaatcattagggacaacacttcgtacggtgccagcgaactatccgttgcttgcagtgtcagaaagtgggtgaaaacaattaaaaatggcggccaaaaatccaacaatcttaatccatgtggccaaacgcggtgtgcaacccgtttagcacctaaaatgatcatcgagatggcggctaaaaataccagctgcccataccaagtggtccataaatctcgcatatgcgtacttgcctccccattagtgtcgggttaaattatagagattatcgttaaacttttcaatcatctgtgacagccctataataaacataaactattactggagggatgaccgttgttacaatactttaccactggtaaaaatggccttttgactacgccggacgaccatcacgatcagccatactggatcaacgttgaacgcccgacctcaactgaaatcgaccaactggtcacacaatttgatcttcccaaagattacttaactgccatcctcgacgatgcggaggtttcacgagccgagcaattatcaaccacgcaatccagtcaaccaatcttaatcgtgatgcagtatcccaaactcacgacgagtaagctgggttaccttgaatttcaagtctatcccttcgccttgattttagtggatcaagtggtcattaccgtcagtaattacccggctagttttattcaagactttgtgatggacccggcctcttctaagctaagtctggataatcatgaagattttgtgctgactatcatgtggtacatcgagcacagttttgtgaccgcactcgaattgatcaaccaacggacaagcgccctggaaagccgtttgaatcaagctactcacaacgtggaactctttaccattatggcttaccaaaaatccttgattcgttttaaggccgcccttaatcagaacacacccacgcttgacgcggttgaaacttcgatcacccatttcaacgcacctaatcaccaatcactcaccgatgacattaagattgagacccagcaagcgagtgacatggctgaaacgaccaatcagattttgcagcaatatagtcaattagtgggttcagtaatttccaataatttgaatgatgtcatgaaatttctgacctcactcacgatggtgttgacgattccaacgattatcggtggaatctatggcatgaacgtcaaattacctggtgccggtctcgtccacgctttcacttggctgatgctaggaacgattattctttgcattattagtatcgaatatttacgaaaccatgactatttttaatttcaattgaaaaaaaactgattccacgttaaactatgaaagaattactcgtaaagtgtggtgcatacaaacataatgaagaaaaaatcaacttttcaaaaaattacgatggtcgttatctggttaatgatcatttctaccattgggtcattggtgcttaccgccttatctgggttaggtttactaaccttctaggttaaacaccttgcgaaccacgaatggttgcaatacttaccaagaaaaaagttacgcttgctcacaacaagcttaactttttttattactggtggatcactcagccatggtcggcaagcttagccaccaacttctgggacaatgtgaattaaaaaaatcacgcatttgtctctgaaaaaggttccaaccgttagtcaaatctggctaacgattggaacctttactttaacgtcgattattcaatcgtatcggcagcgccaccatgtgaagtcatgccattcaaatgatgcccaccaatcttactggacgctaagcgtcattacccgacgcgggcgcttcgtcagccgatttttggcggtaaaccttacgtggcttactcccctccgaagggcccaccacgccgcgttcctccatttcgtcgacgatccgtgctgcccggttatacccgatacggaagcgtcgttggagcatcgagacactggcggactgttgatcagtcaccaattcaacggcttcggcataatactcatcctcaccgtcacgagggtccccactaccagcggcatccgtctcgtcatccttgaccagcatactatcgtcataatcagccgtctgttgggctttgataaagttgacaacttcttcaacatcatggtcagaaatataagcaccctgcacgcgcagtggcttattcatgcccattggctgatacagcatgtccccacgaccaagtagcttttcagcaccgttactatcaataattgtccgcgaatccgtcccacttgaaacggcaaatgccatccgtgacggtacattggctttaattaatccggtaataacatctaccgacggccgttgtgttgccaaaatcatatgaataccggctgcccgggccatttgacccaagcgaataatggcatcctccacttcgctcgaagtgaccatcattaaatcggctaattcatcgacgaccaccacaatgtatggtaagacgggccgtgactgcccatcagccgcattttgttgacggatatattggttgtacccctgcatgttacgctgcttggaatccgcgaacaattcatagcgtcgctccatctcggcaacgaccttatgcaacgcccgggccgccttcttcggttccgtgactacgggcgtcaacagatgtggaatcccattgtaaacccctaattcaacctttttagggtcaatcagcataaacttaacttgacttggtttcgtgttcatcagtagccccgtgatcatcacgttaatggcaaccgacttcccactcccagttgaaccagcaatcagtaggtgcggcattttagacaagtcggcaacgactaaattaccagaaacatcacggccgagcggtacggccaacggtttggtcgggtgcgctggttgggcctcaacgatatcccgaaatgacactgttgaaatctgtttatttggcacttcgattccaatcaatgatttaccgggaatgggcgcttcgattcgaagatccttcgctgccagcgctaacgctaagtcgtccgctaaattgacgaccttgctgaccttgaccccaacagctggatgtaactcatacttcgttacggatggccctaagctgacattcttcacttcaacttgaacaccgaaacttgccaacgtggttgttagcttctgcgagttactctcaatcgttgcgtactcagcactctgatccgtttttggaatcttcgtcaatagtgttgactctggcaactggtagtccgcatcatccatcacttcagtcccttggagttcttgttcatgatcaaccgtagcagctgaagttggggattttatgggcgaggcttcacgatcactagccaccgtgatattcaagtcggcaggcgagctcgtaactgcactggctgctgagtccggcgccgaagtcccgctcgttgtctcagcaggggctgctgactgtggtacggttgacgttggctgcttctcagtacttgccgcttgattggcgcgcacttgttggtgaacccgccaacgggcaatttgaacccggagcacgtgcgtcagccattcataaccggatcgcagttgctggcccaattgcatcaaggcctgacgcaacgcttgcatcgtcttatggaacggcaaatcaaaggtaatgtagatactggcaaccatcaggatcagtgcgatcaaaattgtcccgacattagccaatagtggataagtgacactatagccagcagcgccgactaatccgccaccaagattactggccatgccccccttggcaaaatcatttttgatcagattccacgtcaacgaccaaaaatcggtatggtgattcaattgattaaacatcgggatctctaatagcaataagtaactgaagaaaaacaagttaccaccgacccaccaccgccaagtcagtcgtggccaccgaccaaaaatcatcaaatatcccatgacgaggagtgttagcccggcaaaaatctggtaggcattcccagcaatggctcggaaaaactctgcgaataccatgcccactaaccccaccttcaacaaggcgaggatcgtgaccaatagtccaatcaggccaatgacattccccgtcatctgccgcttagccgcaaccgtcggcttcttcttgcgcgtcgaggtccggcgcttttttgttgttgcttgtctacgcgccacgcttcgttcatcctttctcaattaatactgtcttcattataacaaactcaagttcccccgtccccatcaaaaaacgcaccctaacgtttagcgctagtgcacgttctgttggttacttcaacttatcattttcatagtggtgcgaccgttcaaggttcgggaattgttgttgccgcagggcttcataaatcacaatcgcagccgaattcgataaattcaaggctcgaatatgtgaatcatcttgaggaatccgaatggccttttcgggatatttgcgcataaatggttctggtaaccctgtcgtttccttaccaaataagaaatagtgatccttacccgtatcactataatcaacatccgtatagtcatgttcagcaaatttagacactaagtacaactgatttaaatcagggatactagctaaaaaatcttgcaagtcagcatgataagtaatatcgacactatcccagtagtccaagccagcccgttttaagtgcttatcatcaattttgaagcccaacggttcaatcagatgcaaggccgtatccgttccggcacacgtccgggcaatattaccagtattcgctggcattaacggttcaaataacgcaatgtgatttgtcaaaataatcgtcctcattcatattagtctctacgccatgttcattcatagcaatcctattaatcataccatgtctatggttcaacagcgaactttgaaactaaaaaacgctttgttcgcattcttaaccaatctttcctatactaatcaccgtacgcgccggagggcggaacaggacgcacactggctgacgaacaccaatctaaacctgacacgttgtcatcatgattcatgccggattaacacgtacaaggcagcattcggatcattttataactcgaggaggaattatctatgaaaattatgattattggcgcaaccggaatggctggctcagccatcaccaaactagcacttgaacggaaccacaccgtcgtagccatcggacgttctgaagaaaagctagccgctctaccggctaaccaaaatttgcagaccaaagctaaagacgctttcgatctcacactatctgagctacaggcggttgacgtggtcgttgacgcaatggcgactagtcctgataaggcttaccgacacgtggatctggcaactaagctgatcgctcagctccgcgaacaacagcggccacgtctcctcttcatcttaggggccggtagtttaacaactggtgatgatcaacacctcttcgtgcacgacattgaaagtaatcccgccaatgctgacttcgtcgctattccgcaaaaccaactggccgaactgaccttcttacgaaccgtcaccaacgtcgattgggttggaatttccccggccgccaatttcacagcaggtcctgctaccccggcccagtacggccatgacatattactgacgaacactactggtgaatcagtgaccaatagtggcacgatggcggtagccgttttaaacgaactggaaacgcccaaacatcatcaagaacgctttacagtcgctaaccagtaaacgtcttgcctagcagcgctaaaatatcgagtggcagccaaaccacaagccgagcgctacttgagcaatttagttaactgtgacgcgctttaaataagaccaattaatcccgccagaatctgacgggatttttgtggcgtcgcaattgctggcagtatttaacagctaagtgctgccaccaccccatctctcctcattgcgacagtcgtagccaacattgtcactaaccagttggttgcattacaccgccagttaacgccctcaccgacctttaattaattcttcaccaaagcatgctaaactattgccatgtttatttgaaagtggggataccatgaataaccgtttatcaggacggaatttactcttcatcggcaccatgttatttggactatttttcggtgctggtaacttgatttttccaatttttctgggccagcaagccggccaacacgttggtgcggccattatcggactattgatcaccgggattggacttccattactaggcgtgatcggcatggggctgacgcgcagtcagggcgtatttgacctggcaacaaacgttagccgatcatacgcgtatgtcttcaccgtactgctttactttaccctcgggccactttttgcaatgccacgattagcaactacggcctttcagattggactggcccccttcttaaccaccaaattacaacccgtggtgctattgggcttctccgttgcttttttcgtcgtcacttggttactggctcgtaatcccggtaagattatgacctatgttggtaagtggctgacacccatctttttgctattattaggtgccttaatgcttgtcgctatcattaagccactgggatcacttaacgtcgcggcgagtggcgcctatgtcagccatccagttctaactggttttactgaaggctacaacacgatggatgcgttagcctcgctagcttttggcatcgtcgtgattgatgcgattcgcgacctcggtgtccgtgatccggggcaaatcgcaactgataccattaaagcaggcctaatcagcatgagtttaatggcagtcatctatggcctgctggcgattatgggtaccatgagcttaggtcgctttgctccagctgccaatggggggattaccttagctcaaattgccgatgcctacttcggccgattcggtaatgttttactagctctaattgtcatcatcgcttgcttaaaaactgccattggcctcacttctgctttcggtgatacgttgcatggcatgtttcctaagatttcctaccattggctgatcaccatcgcttgtctcattccagccattcttgctaacgttgggctaactgaaatgattacttattcaaccccagtgctgatgtttctctacccgctcgcaatcgtgttaatcatactggcagtactggcaccatggcttgggatgtcccgctggttatatggaatgacaactgtctggaccatgattccggccattcttgccggcattaacgctatgccatccgcctgggtacaagcatcctggttgcaagctttgcttcatctcaacgcgtggctaccgcttgccaatctagggttaggctggagtgtacccgcactgctaggtttcggtttagggtggttgatcagccgtaaacaaccatctgcttctaaattgcattaatatagcgtcacatataaaatagcggaccttctgatagccatccacgacttttcagaaggtccgctttaaattacgagagccatgccaattgactggttgccattgaacctcaccggtgaatcatggcattattcaggactggtatgaatgcaatagcaacacatggtcacacctcaccgtcagcttttgaagacacaaaaaaacgtagtatttcggtgtgggcacggcgaaacgctacgttaatgaagtacaactcggtagtcaccaacgacatgtcgatgttaactaccaaacgatttctcaaaggttatcttaacaccggcgtttcaatcatgcaagcacccgcgctaacctttttgcatcgttaataaactcacatcaacggtaatcttagttaacccctgccgtttagcggttgcgagctgctcagcatccgcaccccagtgcatcggtgtcatgactaataagtcgttaaagtcaatgttatcaagcgcaacttggtattgaattcgttgccgcttagcagtgggatagtgctgggcaaacagatctaacacccgttgattatcatactgatactgtcgatcagtcggtttaaatagtaaatgacgcagttcaactaagtactcaggatttggcacgatcttcaataactgtccaccgggcgcaaggacccgttcaaactcttggtaagcggatggtgagaagacatccataatggccgtgaatgccccatcggtaaagggtaattgggccaaatcggccacacaataataagcagtcgtcatcaattgggtcgctaagttaaccccatccttactaatgtcaaaaccaatccccacgtcttcagaattggcatgaattgtcaacaaatcagctaggggggtgccttcaccgctaccaatatctaagattcgttgcgccgtttttggcaatgccgcattaatggcttggacaatggggccgaaaaaaccagcttgcaaaactcggcgccgcgctgccagcatgttagcatcgtattcgctagcgacttgatgcgtcagaaaatacaacgtccctttttttgaaaaatctacttgatgcccattaggacaacataagctgtggccgtcaattgtcacgtatgcttgattacaaactaagcatcgaaagcgatcgatatttgcctgaacaaactggatgccgcggtcaatttttttcacaggtgtcaccttaccttggttaattttatcattaggcgtcccatatccaagcgatgcttcccagcttacctgaaactatggattcacgatgacaacatcgtgtaaaggacgtatgttcaatcataccatatcggggcggacaaaatagtagctgttacgatttaggtgtggtatcttattaactgttctaaaggctgacttaaattgtcaaaatgaatttgctaccgaatggcatgaatttaatgacataaaggagactcattcagatggcaaaaaaatcaaaaattgcgaaagaaaaacgcatcgaagcaaccgtggctaagtatgccgaacgacgccaagcacttaaagctgctggcaactataccgaattggcaaaattaccacgtaatgcttcacccgtgcgtattcatcggcgcgactcacttgacggtcgaccacatgcttacctacgtaagttcggcatgtcgcgccttaactttcgtcgcttagcgcacgctggtcaaattccaggtgttaaaaaagcaagctggtaaagtgacaactggcgtgatattcactaatgattagtaacataaccattcagttaaattaaaaaggttccacagaattgtcatcagacttctgtggaacctttttaatttggcgttattggtttaatcgcgtttcagcgccatctgagtagccaacaattaccttacttgttagtttgatcagttgatggggttgcttcagcctcatacaatcccgaagaccgtcgataccagtcaaacagatgtgtccacaaaactttcaagatcgcatagcctggaatcccgaaaataacccccatcaacccgaagattttaccagccgctaataggacgactaaaatcgtaatcggatgaatagctaagctactccctaagactaacggtgagataaagcggccttcaatcgtttgttcaatgacgaagacaatcagaacttggaccaacatccatggtgaggtgactaacgcaatgaccactgaaggcaccattgcgagaaaagaccctaaatatggaatcaaatttaagattccagccgcaattcccaacgtcagcgcaaatttcaagccaataatactgtaaccaaccgcaaacatcacggcaacaaagaacgccacggtcaattgaccacgaatataattactgacctgtgaattgatttctgtcaaaacttctaagaatcctgagcgcgctttggtaggtacaaacttagccatatacttcggtagttgatgaccatcgcgcaataggtaaaaaagaataaacggcattgttatcaacccaatgatgacggtcgttacggtactaaatacgcctgtaagtgaagtcaccgtcccggtcaaatacttcgaaaagcggccactcactagcttactgagatccgtgttccaactttcaagttggtcacggatactactgagttgcggatcattgagccagcgattaacttcagtactggcatttttccaataattgggccagtcattgataattgataaagtttgatcgcgaatcgttgggataatcgcaataatgcctaacgccaacagcgcgacaaccacaataaacaaaccaatgatcgtccaggttcgtcgtacgcgaaaacgcttttctagccagtcaacaagtggattaagcaagtagtacagcacaccggccaaaataatcggcaaacccacgatgctaaaaaattgccggaccggatctaatagccaatcgacttgcttgcccataaagaagatcgtcaatactaataaaataacgaccaaaatccgaatgagccgttgcgctgaccaccgttgtttctgtgaatcaggtttcaaacaatccctccttcctaagcctgatacgtaataacactaccgaccttgattgttggtaactggtttggtgtcaaataaatgccgttttccattggtttggcaggtactggtttgaagtacaacgtcgcgtgcccaattgacgttaaattagcttccactagtccccctgcaaaggccaccgtataagtttgtcgatcgatcgtaatggtgctaccagcaactaacgacagactcgcgatgggctgctcaaatttctgaatcaccgcgatttgctgtaatggtgccgtggccgtttcatcgaataaaactaaaattggttccttggaatcgatagcattcgcaccaatcgattgtactgttgcagttattgtcatattgagacccccatcggttaattaattgctttaattgtagcatagtcctaatcacagacgccaatttgtcatcgcttacacgggccatatctatgctatacttgaattatctatcaaggaggtttgttatcatgcaagaacgcattttattcggaacatatacgaaaaaaacaagccaagggatttaccaaggaacccttgacaccactgccaaaaccttaaccaacgatggcttactggcagccactcaaaatcccacctatttggccctctcagctaaggattgcctatacagtgtcgataaggaagatgacgagggcggtatcgctgcttggcaaatcgacgggcaaactgctcacaaactaaacaccgttgtcgcacctggcaccccaccagcttacgttgctgtcgatgaggcccggcaactcgtctacagtgccaactatcataagggaacggccgaagtcatgaaaattgctgctgatggcgcgctgactttgaccgatactgttcaacatagtggccatggccctcgtcctgaacaagacggctcccatattcattacaccgacctcacgccagataatcgcttagccgtaatcgatttaggtagcgataaggtctatgtctataacgtcagcgacgccggtcagttaagtgaacaatccgtgctcactatggaagctggctttggaccacgtcacctcgtgttcagtccagacggccaatacgccttcttagctggtgaattatcgagtcagattgcgagcttaaaatatgacgcccaaactggtgcctttacgcagcttggcattgtgaagaccattcctgccgactacacggcgcacaacggtgccgcagccatccgcttaagtcacgacggtcattttctctacgtctccaatcgtggctacaatacgttagctgtctttgcagtaaccgccgacggtcatttgaccctgattcagcaaatcagtacggaaggtgacttcccccgtgattttgatttagatccaactgaagcctttgtcgtggtcgttaatcaaaacactgataatgccactttgtatgcacgcgacttaacgagtggtaaactaagtctattacaaaaggacgttactgtgcctgaaggcgtttgcgtccgtttctagtaaaggatgaaactcatgttattaaaagaagtctgtgttgaaaattacactaacattcccgcagccattgcggccggtgccaatcggatcgaactcaacgataacctatccgttggcggtacaacggtcagtcgtggtgtaatggctgaggcagccaagtataccagtgaacatcacgtgcccctagtgaccatgattcgcccccgtggtggcaatttcgtttataatgatacggaattaaaaatcatggaagcggacctgctacaggctcaatcattaggtgttgatggtgtcgcatttggtgctttgactgcggataatcagcttgacgaagaagccttagcgttattaattggtgcagccggtggcatgtcgatcaccttccacatggcttttgacgccatccctgaaaatcaacaagccgcggcaattgactggttagtagaccatgacgtcgatcgcattttgacacatggcggcccacttgatcagccgattgctgactgtgtcccccacttgcaaacgacgatcaaacaggccgctggccgaattcagatcctacctggtggtggcattaccaccgccaatgtcgccgacatcaccacaacgctcggcgtcaaacaggcccatgggaccaagattattaattactaagaactgccaaaaaggcgcatctcattttttgagatgcgccttttgattggcgaagtaaactaaaaaattagaccattaatcacggttattcaatggtctaatattggcacaagcgcccgcactaagccaacttgccctgagccctcttccgcgaacaaattggtcattgtcaacgctgatcaattggctcgtgttcatcatcaatcatgctaattaggataaacataaaacggaccaaatcttaatggtcactttatgaattggcacgttgattatgaataattaaacggttaagatcagccggtaatggtgcaaaggtcgtgagggtctggctaatgaatggatcatcaaattccagttgcatgcagtgcagtgcttggcgctgaatccacgggtcacgaggaccgccataaagggcatcaccgatcaatggatgaccgctagctgcaaagtgcacccgaatctgatgcgttcggccggtatgcagccgtacccggacgactgtcatgttacgcagccgcttgaccacccagtactcggttaaagacggcttaccgtcgggacgggtcgttcgtttgataaatgaatcagcggcacgaccaatgggcgcatctagccacccgtggtcagtcgtcaattcaccactgacgacggctaagtacattttgcgcatcgcatgggccttcaattgatgatcaataatcgaatgggcaaaatggtgcttagcgaagagaacgataccgctcgtatcccgatccaaacgcgtggtgatatgcacaacctcattatcataatgggccgcttgataataaccttttacccgattcgctaaggtattgtcaggtaaggcatgcgccggtactgaggccactcctgctggtttattcacaatcaggtagtcacgatcctcatataagatatcgatcggcaacgtcgagacgcctaagtggtcattaccaatttcagcaggtgtgaccatcgtcacagtctcaccgcctgtcagcatatgaatcgctaataccggtcgttcatcaacgagaattgccccaccatgaaacttaacttttttcaacaaactacgtgtcacaccatgttgtgccaagagtgtcttaactttcatcggggtcgtctcatggttgatccaagtaaacctcattgctcgtccaacccgatgaaggatgtcccgacccgttgccagaagcgattatgacgatgctgagcaaatgcaattcgacgattagcaattgaataacgaatttgttcaattggccgcggctgcgtatccatttgatcagctgtaaagacaaagtgtgactgctgttgtggccgaatcgttattgtttcatacggcgctacgatgactggcgagcctaatgttcggaagactcggttgttgatcgacgcaatctcggccatttgtaaagcgtccaagcgcggatgaatgacagcaccaccaactgacttattataagccgtcgaaccagttggagtggagacgcataacccatcgccacgaaaacgttcaaatagttcatcttgaatataaacatcggcaaccatggtactcccaagcttcttaagcgttgactcgttcaacgccaaataatgatcagtcgcatccgtatccgcataagtaatatctacagctagcaagggataggtcacactctggccgttgtcttccagtaaaccgttgatcagttggtcgatttcataatctcgccagtccgtatagaagcctaaatggccagtatgcacgccaacaaagcgaacttggtcaaccatgtgactatagtggtgaaacgccgctaaaagcgtcccatcgcctcctaccgacaaaacaatgtctgggtgctcatcatcaatttcaaacccggcagccagcagtttagtatgtaactcacccgctactttcttggtcttggcactcgcatttgcaaaaatcgttactttcatgaattttgatcttcctttgtcgtgtcaggctcatcgttgcccggccccttcccatacgagaacaagctctgagcttcttgaatttcctcacgaatttctgacatttctttatccaaactaaaggcggcttccgcagcccgttgtaatcgttgactcaagttttcagggaaatccccttgatatttatagttaagcgaatgttcaatggtcgcccagaaattcatggcaagtgtccggacttggatttcggccaaaattttcttttcaccaccgaccatttggaccggatattcaatcacgatatgatacgaacggtaaccagatggcttttcattactaatgtaatcgcgttcttccagaattgtcatatccgtccgttttcgcaataaatcaacgacctgatagatatcctcaacgaattgacacataatccgcaaaccagcaatatcctgcatatcttgttctaggcgatcttcttgtactttacgtcgggtcatcttttccttaatgctatcaacgggtttgacccgccccgttacaaattcaatcggttcatgctgattcaaatcacgaaattgtttgcgcattccccgcaatttaactttaagctcatcaacggcttgctgataaggcagtaaaaaatgattccaatcttccatcggggcacctccgtttcaatccataccctaaaattttaccataaatcgtcggaataaaaagttaacgttctcgagattgaaccctaagttcactttttttacaaactgtaatcctagaaacaaaatactttacgaatttagcaaatcggtgcatgattacgggtgaaggtttaagctaagtaacgagtgattttctgcattaaaaaatttatgaaatgaaaaacttgcaaatacctcgtttgattggtattctgcactatgacgcgaatagagaaagtggaggaattataacgtgttagaagtgtatttatttgtaaatccgttggcaaaccaatgcgtacgtgatgagcaaaacgtgttacggttggcaaacgactcagacaagcaaatccaatttcaattcgtaccattactcaatattaatgtgattcaacgggctctaaagtgccaaggaatcaaggcatccgactggcatgctcaaaatcaacagtctcaaacattgtaccgagttattttggattataaagccgccctttttcaaggcaaaaaacgggggcgtaactttttaattgccttgcaatctgcaatgctcaaggctggtcaacactattcggaagagctcgtcaaaacggttgcaactaactgtcagattgacttagacatgttcatggaagatcgggacagtgacttggcgaaacaggcctttcatgctgatcagcggcttgcatctgaaatgaacattaccgaagcatcgtcggccgtcgtttttgattgcgaccaatatgattatggtgtcttgctagaacattttaattacacgactctttttgacttagtcaatggcaatctggatccttttcaagatgcaactcgggcaaccaatgccagctgtgctagccttgccaacgcacaattacacgttttataattccagtaattgcaattattcaaccggtcctaccagtcaaaagcacccgacgatcattttcgccgggtgcttttgactgtatttaccttttatagctgccagaataagccttctggactcggcagctaaccccctaactgataagcgggtcaggtctaaaataagcgtcgggaccgaacatcctgacgctcattgtgcttgcttttataactggttaatcttgggtgaccaactgttcaaattcatttaatcgttcttcaaatacctcgaaagctgcatcaagataatcaggcttggtcatatcaactccagctcggtgcatgacatcgattgggaaagcagatgaaccagctttcaagtaaccgagataatccgcaacagcatctgtctgttgcgtactaatacggtcagccaacgttgaggccgctgcaaaacccgtggcatactgataaacataataattgtaataaaaatgcgggatacgggaccattcgtcggcaatttgcggatcactgacgacggcgtcaccatagtagcgttggttcaactgcaaataatgttttgacaagcgatcggcagtcaaagcctgaccttcttgatcttgctcatgaagccactgttcaaactcagcaaattgcgtctgccggaaaacggtgcctttaaatccatctaagtagtaattcaagacatacgcccgcatttttggatcttgttcagtcgctaagaaatagttcgtcaacaagttttcattagtcgttgaagcaatttccgccacgaaaattgaatagtcaccatactgataaggctgatgatgtgtcgtgaagtaagagtgcatactgtgtcccatttcgtgcaccaacgtatataaattatcaatattatcctgccagttcaacagcatgtatggcgcggtatcatacattcctgacgaatacgccccgctacgtttgccttgattttccaccacatcaatccaccgtgaagcaaacgctgttttgacgtgtttgagataatcaggacccaaaattttgagcgcttgtaaagcagttgcttgagcctgctggtaggaatagttggtcgtcggcttgggtgccaatggcgtgtacatatcatacatatgcaactgatcaactccgagcagttgtttccgtaacgcaacataccggtgcaataagtccaaatgcttgtcaacggacgtgactaaagaatcgtaaaccgccgtcggaatctgattggcagcaagtgctgccgtccgcgcatctggataatgatgagcctgggcaacaaaattgtgtaccttgacttggctagctaaagtcgaagcaagtgttcgccggaactggccgtatactttatacagtgcttcaaacgcctctcgccgaacagccggatgaacggactcaagtaacaccccataaattccttgtgacaatttgacagggttgccgtcgtcatcctttaccgttggaaattgaaagtcagcgttattcagtacaccaaaagttttcgcagaagcaccaaaaatatcactagcgcctgcgagtaaagcttcttcgctttcagacagaacgtgtcccttttgcaaccggatcgtatccaacaaatgccgataatcacgtaaatcgacgttttcatcaaggtacgtatccaattcgcccggcgttaattccaagattgctggttcgaaccaggcagtcgctgcggataccttggcagtcaaactactagcttgatcgtctaaagccgcattggtactattgccagtatcctggtcacttttcagacttgcgtataccgccactttctctaaccgacgatacagcgctaaaacagcctggatgccagccagcaccgtgtcggccgagcttgtaaacgtttctttaagcgcagtgacggtggggattgcagctttgacttgtgcaatatccgcctcatacgcggcctgatctgcataaatgggcgtcaaatcccacgtcagttcttcaggaacggccgaacgggtcggcaattgtttggttgctaccatgcaaattcctccaattatttcaatatagcactagattaccacagattgcgcctatcgcggtagcatctgttccggaatcaatgtttgcgccatcgaagctggccggaattcacatgccactcagttttctgccagtttatcacttgctgctcgctaagcatcgtaatcatggtcgttatcagttgttgtattaacgtgcctcgtgcttgcaggcaggcacgccgggcaagtaatggccgtaatttggcccagatcaatgcctctaattgtggcccagtaagccgtccggactgttgccgcagtgcaaaaaagacgtgggcgtgccagaccagatatggtaccgataacagcggtagttgcggcacagtgggcatcgtccacgtcggtaactggacaatcgttcctccgcgttgatagcaagccacttgtaacgcatcaaaaccacgttgatgtcgaagccgtgccaacattaactgttgataataatgccgtaaatgcgtgtccggcaaagttggggtgttaattttaggagccaattggcgaaaacgtaacaccgactggctgcgcgtatccagtcgaatcgtttgataggtcagcggttccgtatccaatgtcaagacgtgatgcaataaacgaacactagtactttgagtgtccaaaaaaagtagaaacaggccccaccgttgctggtactgcaaaaacttcaaagccttgctattgaggtgcaattgtcgctgataggggcgtcccaacaaccataacacttgatagccatgctgacgatagccctgcgtccgagctgcgagtcgctccactgacaagggtgaacactgaaattctaacgcgagtggttgcgctgtacctcgtcgaaccaagatatccgggcgctgatgtatctctggcaaaccagcctctaagcgcaccgtataaccactggcagcgaaccaggtcgctaattgttgtttaccacgaagatgttccgttgtttccccttcagagaaagcatcacaatccgtggcatggacgtgggcaaaatgtggcacgatcactgccccccgtttcaatcgcaccggctgcacacatcctggacagtaatattctatttggcgatcagccgtcgccgcattaacgagttgatgctgggcatccatcgcgatcaacatgatggtccctcccttcaacaactaattacgtcattaaagccaattctcacgcaaacccatcatcatttattgaccccgagcagcacccgtcttttggcaaagcgtccggcaggcagattgtttatccgtggatacaaaaaagccttaacattacgaataaacgttatgttgaggcaattaactgctatttaaaatagtgccggatggtttccaaagcagcattagacatgatcttttcaccatgttcaagtagtacgtcagctgaaatattagctaaatgggcatattccaaggctactgcgacatcatctttgatagtggccgttgatgattgatcgacaaagaaaaccagttctagataatattggtcgcgatacttgaataagttagacgcgagtccctctggccggaataattgtgccaatgaaacaagatcctcaaattgatcgaatttcaacacgtattccttagttggtgtatcaggatcatccaaatacggatcgagatcattagtgtccttagttggattatgtgcaataccttgtccatcttcaacctgattcgtatccgtctgcatcagtttacgcttcaaataatctgaaacatcatcttgtgagtcgctatcatccgattggtcgggtgactgagttgctttagcaatcgtatcttgtaaattatcactgtttttgctaataaataattctaaaccatttcggtttggtaatacttggaaagttacggcatcattgtcctgaaattgatgatcaacatcaacttcctccaagatgctatagaagaaactttcaatttgcttatgattccctagtaaatctagtacgcgaataccgcgttcattgagatcatcatttccaataacgacgcgaatcgtatcttcgttgatgcgttccatctccattacagatccacccctttctaagtgtcaagggccataatcactatcacaattctaacttatttcagtttattgtaaagtaatctatctgaaaatacaaaaattggccaattagttaagctaactagccaatgataatcacatatttgctaattgttgtgcccgtaataattctaatgtccgaattttgcgtggcaagaagcggcgaatctcgtcctcattgtaaccaacttgcagccgcttctcatcaagcataattggtcgacgtaacagactaggatcatgagtaatcatgtcaaacaattcattgagtgacaaatcattaatatcaacgttcagttgttgaaaggcctttgagcgagtggaaataatttcttccgtccctgattcagtcagttgtaggatctgcttgattttttcaattgaaagcggttcggtaaacagattgtgttcttgaaaatcaatgtcgtgtgtctgtaaccaagccttggctttgcgacatgaggtacaacttggtgcggtatataaaataaccatcctgggtcctccttggcatcgttaatcaattttataacataattcattatacgctactcacttttaattgtgaataggtttaacaaaattaatttatttaaaactaataatctaaaatacaattattcgatatatgtattttttctatcaaataaaccgcttttatagtcattcttgttattaattaattcgtatacaatttaattatgacttatgatatcaataatctattaacggtaaactgacagaaaaagcttagcaaaatgatttgctaagccctatcatactagccaagattcaattgtaaaaacttttgagcaactgtcacttgaatgtcattaccggcggctgcttgtgcttcttgttggagttgtgtaaatgagacatcttgtggcaagtgtgtgagcaataattttttgacgcgggcatctttggcaattttaccagactgtgccgacgtcatatgccacattttaccagttttatctgcggcaaaattcgtatcagtcatcaataactgtgccccggctgcgaaagtcgctaattctggcaaataagccgtatcggcggaaaagacaagttcttgccccgtcgctcgctcgaccaacttaacggcataggctggaactggatgtttagtcggtaaaaagctcacatcaaacggcccaatttgattgacagcagccggatcataggcccgaccttctgtggcattcgcccaggtcaaggcaccaaagttaagtggatcagcggtgtgcccgtaaatcggcagcacgggcgtcttccgttcaccagcacgcaactgccagtaatattgtaagaccccaacgtccgccgtatgatcgtgatgataatgagtcaggagcacactatcgagctgtaaggggtctaaaatctcttctaaggcgtttagcgcccccgacccacaatcgagcaataaatggtaatcaccggctgtaatcaggtaagaactcgtacccacgccatcgtatggataaccaccatagtaaccaagaactgttagtttcattattgaccatcccttcatttctctgtccacttctattttaatatagcaccaagaaaaaatgaaaccaacaacttaacatattttcaattattttgaaaaacacgtataataatagatgtaataaataaggagtgatattgatgagtggaaagattgcagcaacatttgggacacgtaaaattctaaccatgatccaacaacaaaatgctgatcgtgacttgttattaatgcaggccaacgccactgaagatcgctatatgctactcgatttaaccggcgaaaaaaccgttttttcaagccccgtaacgtatgacgttttactttcaaaaggatcagctgactggcatggaatgacaagtttcatcttcattgatttaccggaagaagaacaaaaagtctttaaatctaagtttagtagtttccgacacgattataataagccagatgggctgaaacatttttggatcttacgtgagtccaaaaataattcagccttcgtgattgtcacaaattggcatagcgactccgaatatgctgtttggctgcgaagcgcttcattcaagccatttgccaagtacatcacctcagattacggctaccacgaaagtcgctattcatttgtacgttcattaaaatcataatcatccggtattggatatttcaagtcgctgcagtgattgaactgcaacgacttttttcatgaatattacttttactcaacactgctaaatctcatcagttgatatataagcctcgttcacaacatcacattgcagtcagaaccaacatatgtcccgatcagtgtgatcctaaagaatctgccgtcagctttagttgagcaatcgtgagccccaatcagccatctgttgaatgacacccaccctatttactgattacagtgcgcacctctttaggtgatctcgtcaaacagttaatattctgaaaacacaaaaaaacgtcattcatcaacgaatgacgtttgtgacggtccgtacgagactcgaactcgtgatctcctgcgtgacaggcaggcgtcctaaaccaactagaccaacggaccaattgcgggagcagggtttgaacctgcgaccttcgggttatgagcccgacgagctaccagactgctccatcccgcgataatataatgacccctacgggattcgaacccatgttactgccgtgaaagggcagtgtcttaaaccacttgaccaaggggtcatatttttaaatggtacaacggagaaggagggattcgaaccctcgcaccgcttgcgcgatctatacccttagcaggggcacctcttcagccacttgagtacttctccaaaatgggcctaaatggacttgaaccatcgacctcacgcttatcaggcgtgcgctctaaaccagctgagctataggcccaaaaaaagcgggtaacgagaatcggactcgcgacaacagcttggaaggctgtggttttaccactaaactatacccgcagaatacagatatggcgcgggacggaatcgaaccgccgacacatggagcttcaatccattgctctaccgactgagctaccgagccattgtagccatttagaactattaacttaacggtccgtacgagactcgaactcgtgatctcctgcgtgacaggcaggcgtcctaaaccaactagaccaacggaccaaattgcgggagcagggtttgaacctgcgaccttcgggttatgagcccgacgagctaccagactgctccatcccgcgataataaggaggatgagagattcgaactctcgcgtggtttgacccacctgacggttttcaagaccgttcccttcagccagacttgggtaatcctccatatgatgtaactaggaaatgtccactattaatagtagatggaccttgtagggctcgaacctacgaccggacggttatgagccgtctgctctaaccaactgagctaaaggtccaagctctaattcctatcgcggcagggggaatcgaaccctcgacctcccgggtatgaaccggacgctctagccagctgagctacaccgcgatgtgttaaataatcgtatatgactacttaatcgggaaaacaggattcgaacctgcgaccccctggtcccaaaccaggtgctctaccaagctgagctatttcccgttatatgcacccagtaggagtcgaacctacaaccttctgattcgtagtcagacactctatccaattgcgctatgggtgcttcataaaagtgccgaggaccgggatcgaaccggtacggttatcactaaccgcaggattttaagtcctgtgcgtctgccaattccgccaccccggcaacactttggaacaaagcggaagacgggattcgaacccgcgacccccaccatggcaaggtgatgttctaccactgaactacttccgcataactattcagttaatgccgactagaggattcgaacctccgaccccctgtttacaagacagatgctctgccagctgagctaagtcggcatgacgattaacacaactataacatcatatcatgctcagctacataaatcaacaataacttttgtgaaactatttaattatgagccgtaaacaatgagccgtgacagtctcgaactgtcgaccctctgattaaaagtcagatgctctaccaactgagctaacggctcatgatggaggatacagggctcgaacctgtgaccctctgcttgtaaggcagacgctctcccaactgagctaatcctccaatttcgcatggcaacgtcctaccctcgcagggagcgatcccccaactactctcggcgctaagaagcttaacttctgtgttcgacatgggaacaggtgtatccttctcgccatcatcaccacactatgtgaaactaaatattaaattgaataatatccatttaaccttgcggttaaatgagccgtgacagtctcgaactgtcgaccctctgattaaaagtcagatgctctaccaactgagctaacggctcatgatggaggatacagggctcgaacctgtgaccctctgcttgtaaggcagacgctctcccaactgagctaatcctccaatttcgcatggcaacgtcctaccctcgcagggagcgatcccccaactactctcggcgctaagaagcttaacttctgtgttcgacatgggaacaggtgtatccttctcgccatcgtcaccacactattgagaaacttgtgctctcaaaactagctaatatcaaatatcttcatatgaaccggaacaccaattacttggttaagtcctcgaccgattagtattagtccgcttcatgcgtcaccgcactgccacttctaacctatctacctgatcatctttcaggggtcttacttccataaaggaatgggaaatctcatctcgaggtgtgtttcacacttagatgctttcagcgtttatcacatccatacgtagctacccagcgatgcgcctggcggcacaactggtacaccagaggtatgtccatcccggtcctctcgtactaaggacaggtcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggtaccaccggatcactaagcccgactttcgtccctgctcgacctgtctgtctcgcagtcaagctcccttgtgcctttacactctgcgaatgatttccaaccattctgagggaacctttgggcgcctccgttactttttaggaggcgaccgccccagtcaaactgcccacctgacactgtctcccaccacgattagtggtgcgggttagagtggtcatacagcgagggtagtatcccaccaacgcctccaccgaaactagcgttccggtttctatggctcctacctatcctgtacaagctgtacaaacactcaatatcaagctacagtaaagctccatggggtctttccgtcctgtcgcgggtagtccgcatcttcacggacaatataatttcaccgagtctctcgttgagacagtgcccagatcgttacgcctttcgtgcgggtcggaacttacccgacaaggaatttcgctaccttaggaccgttatagttacggccgccgtttactggggcttcaattctgagcttcgccgaagctaacccatccttttaaccttccagcaccgggcaggcgtcagcccctatacgtcatcttacgattttgcagagacctgtgtttttgataaacagtcgcctgggcctattcactgcggctgatcttgcgatcagcaccccttctcccgaagttacggggtcattttgccgagttccttaacgagagttcactcgctcaccttaggattctctcctcgactacctgtgtcggtttgcggtacgggtagttaaatactcactagaagcttttctcggcagtgtgacatcagacgcttcgctactaaatttcgctccccatcacagcttgtccttaaagtgaaaagcatttgactcttcacaagacttactgcttggacattctaatccaacagaatgcacatcttagcctcctgcgtccctccattgctcaaacgcacttaactagtacaggaatctcaacctgttatccatcgtctacgcctctcggcctcgacttaggtcccgactaaccctgggaggacgagccttccccaggaaaccttagtcattcggtggataggattctcacctatctttcgctactcataccggcattctcacttctaagcgctccacaagtcctcacgatcttgcttcaccgcccttagaacgctctcctatcacgcgacctaatggtcgcatccatggtttcggtagtatgcttagccccggtacattttcggcgcaggatcactcgactagtgagctattacgcactctttaaatggtggctgcttctgagccaacatcctagttgtctatgcaactccacatccttttccacttagcatacatttagggaccttaactgatggtctgggctgttcccctttcgacggtggatcttatcactcatcgtctgactcccggatatgaatcaatggcattcggagtttatctgaattcagtaacccaagacgggcccctagtccaaatagtgctctacctccatgatcctaattccgaggctagccctaaagctatttcggagagaaccagctatctccaagttcgtttggaatttcaccgctatccacacctcatcccagcaattttcaacttacacgggttcggtcctccagtgcgttttaccgcaccttcaacctggacatggataggtcacctggtttcgggtctataacctcgtactcaaaacgcccatttcagactcgctttcgctacggctccgactttttagtcttaaccttgcacgggatcataactcgccggttcattctacaaaaggcacgccatcacgcattaacgcgctctgacttattgtaggcacatggtttcaggaactatttcactcccctcccggggtgcttttcacctttccctcacggtactggttcactatcggtcactaggtagtatttagccttgggagatggtcctcccggattccgacggaatttcacgtgttccgccgtactcaggatcctgaactgagagaatttgatttaatctactgggctatcaccatctatggcggattttcccaaatccttcgactatcaagttctttggtaactcaaatgttcagtcctacaaccccaaagtgcaagcactttggtttgggctgttccccgttcgctcgccgctacttagggaatcgaaatttctttatattcctgctgctaatgagatgtttcagttcacagcgtttacctccaactagactatgaattcatctagtggtaacagttgattaaaactgctgggttgccccattcggaaatctccggatcatagcttacgtacagctccccgaagcatatcggtgttagtcccgtccttcatcggctcctagtgccaaggcattcaccatgcgcccttgttaacttaacctcatttacctaacggtaaatgcgattaatgagtttagcgataattaaacttcaataaaaaactcaaaaaacgcggtgttctcggtttcattatgaaaaaatatatttgatattatctagttttcaaagaacaagttttgagagttaaatctctcaaaactaaacaaagtttcgacgcgtgtgtaggtttccgtaatattccttagaaaggaggtgatccagccgcaggttctcctacggctaccttgttacgacttcaccctaatcatctgtcccaccttaggcggctggttcctaaaaggttaccccaccgactttgggtgttacaaactctcatggtgtgacgggcggtgtgtacaaggcccgggaacgtattcaccgcggcatgctgatccgcgattactagcgattccgacttcatgtaggcgagttgcagcctacaatccgaactgagaatggctttaagagattagcttactctcgcgagttcgcaactcgttgtaccatccattgtagcacgtgtgtagcccaggtcataaggggcatgatgatttgacgtcatccccaccttcctccggtttgtcaccggcagtctcaccagagtgcccaacttaatgctggcaactgataataagggttgcgctcgttgcgggacttaacccaacatctcacgacacgagctgacgacaaccatgcaccacctgtatccatgtccccgaagggaacgtctaatctcttagatttgcatagtatgtcaagacctggtaaggttcttcgcgtagcttcgaattaaaccacatgctccaccgcttgtgcgggcccccgtcaattcctttgagtttcagccttgcggccgtactccccaggcggaatgcttaatgcgttagctgcagcactgaagggcggaaaccctccaacacttagcattcatcgtttacggtatggactaccagggtatctaatcctgtttgctacccatactttcgagcctcagcgtcagttacagaccagacagccgccttcgccactggtgttcttccatatatctacgcatttcaccgctacacatggagttccactgtcctcttctgcactcaagtttcccagtttccgatgcacttcttcggttgagccgaaggctttcacatcagacttaaaaaaccgcctgcgctcgctttacgcccaataaatccggacaacgcttgccacctacgtattaccgcggctgctggcacgtagttagccgtggctttctggttaaataccgtcaatacctgaacagttactctcagatatgttcttctttaacaacagagttttacgagccgaaacccttcttcactcacgcggcgttgctccatcagactttcgtccattgtggaagattccctactgctgcctcccgtaggagtttgggccgtgtctcagtcccaatgtggccgattaccctctcaggtcggctacgtatcattgccatggtgagccgttaccccaccatctagctaatacgccgcgggaccatccaaaagtgatagccgaagccatctttcaagctcggaccatgcggtccaagttgttatgcggtattagcatctgtttccaggtgttatcccccgcttctgggcaggtttcccacgtgttactcaccagttcgccactcactcaaatgtaaatcatgatgcaagcaccaatcaataccagagttcgttcgacttgcatgtattaggcacgccgccagcgttcgtcctgagccaggatcaaactctcaaattaatgatgagttctaaaaagctcatttaatgttgtactaaaatttatttgctagcgaattgacttcgcaaatgttttgctcttgattcaaaatcaagagaccctacacatttgattcgtcgaaactttgttcagttttcaaagatctaattccgtgcgttaatcgtttaacacaactattacataatatcatttcatcatttccttgtcaacaactttatttaagaagttgaataactatgcaaatgaatttgaaacgttattaccataacataatcgttaacacctcaatcagttgaattgttaacgcgacaagaaatatcttatcattagcgattactcatgtcaataacttttttgctgttttgaatatttattcacttacaacaatttgaaatgaaacaatgtaagtgctagcggctagctgtttaacagcagtgctcgcagcgacaagatatatattatcaagtattagtatgcaggtcaaccctttattcgaatttattttgataaattcgtaaacggcattgtttcactcacacgaacactcgtaaataactcgtgcaattcactggctagaacaaactcgagcccttgacgatcaaactttgcacgtacctgcccgtcaacagctaggtggtcaaagacaaagaccgcaactttttcatcatccagctcagccataatcgaatcatacaagcgcaattggtcaacatcaataccaatcgtatatcgcaaatcccacaatactgacgctaaaggcgaatgccctgctcgtactggcaactgataaaaattgtatccattagtagaatgcttaactaaaaagtcgacccttgctggtcattataaataattgtcccggcaacttttttctgcactaatactcacccgctttcaatcgatttagtgaatccgaagtccaactcgctaaatgattggcaattggttcaaagccagcatgaacatgccgattcgtccaaaaatgcttatgccgaaaagtcttgtagatttccaaatcattgaccgtcggatgcggttgatgctcgatacaacgtaatgacaagctgatttttccagtatattcgtcaatatctaaaataataacatctacggcttgaccaacctttagatactcagtaatacttttaacgtatccttcatgacactctgaaatgtgaatcaatccctgatgctcaccatctaaggtgacaaaagcaccatatggttgaataccagtgactcgtccgtgtacccgcataccaattcgataattgctcacgatcataccatcctttctcattcattctatattgtcgataattctaatccccaatattataacctgaatacagcggattgcaaaatcgtaattgcaaaaaagaaacccgcagccgcagatttctttcaaactaactaatcttcaattgtaattgtttcgatcacaacatccttcactggtttatcctgcataccagtctcagtggccgcaatcttatcaacgatatccatcccatcactaactgcaccaaaaacagtgtgccggaaatctagccagggcgtgccaccattgccatacgcagtcacgatttcttccggataaccagcttgcttcatctgatcactcatcccagcatctaattgtggcttttgaacgataaagaattggctaccgttcgtattaggaccagcgttggccattgataatgcccctcgcaagttgaaaacctcttgtgagaattcatcttcaaatggtttaccccacaaactttcgccacccatcccggtaccggttggatcaccaccctgaatcataaaatcaggaatgacccggtggaagataatgccatcgtagtaacccttctgagctaaaccaacaaagttttcaacactcttgggggcctgctttggaaatagttgaaccttaatatcaccaaagttagttttgattgttgcttttggtccatcgacctgacttaaatctaattgtggaaatgccacaaaatcacccgttttctattaagattatcttgataatacaagagaactcgattaaatgctagccatttgtaaggatttcttgcgattagcgactaagcatagtatttccactgattttctggtaacctagataggattaatttcacattacttggaggtaaccatgagttttttaatcgattttgtgttgcacattgaccaacacttagtcaccatcgtgaatagttttggaatctggacctacctaattctctttgccatcatcttcattgagactggcgcggtcattttaccatttcttcccggtgactcccttttatttgcagcttgcgcactcgccgctaatccaacctatggcttacatatctggacttttgtcattctcttcttggtggcagctttggcgggcgactcacttaacttctatattggtcattccctaggagaacgcctaactgaaacatcctggtttggtagactgatcaatcaaaaacagctggcaaagtccgaaaaattcttcgaaaaacatggtggcatcaccgtgactatcgcacgcttcatgccaatcatccgaacctttgtcccatttgtagctgccagttcgcgaatgaagtatcaacaattcattcgctacaacgttatcggctgtgtcctgtgggtcattctctgttgtggtggtggctactacttcggtaatatcccgttcgttaaggaacacttttcgatggttgtcattggaatcatcctggtttcactgattccagctgtcttctctgctatccgcgcacgctttagccatccaactgaaaacgaagattaatccaattataaaaggccgatcagctaataatagctgaccggccttttataatctaacttaaaatgcagtgtccactgtaaatactcttcattaatccgcttcacgtaacgcttgtctgccgatactgagtaagtaaaaaaaagaccactcaatcaggataaacgctagaacaaagcactgaccgaagaacgtatccggcaagaccaaaatgattcggtccaatagtggatcgaacaaccagtccgaattgcgaaataagatcttatggaacatgataaagaactgatcaaaattgatagccattataacggtcactactggtggtacccagagggctgtctgcatcggtaatactaaccgccacaattgtcgatcacgtcgtagtcgctgccaaaaaaaatagaccacaacactcgtgacgataaacacaccgtaatcaagcataaatagattcttcacatccgaaaagtgaaccaacgcactcgtcgaatccgtaaaatcgttcatagttaatttgggtacccacggaaagttaagatatgctaacagctgatagtagttcgtcatcagccgtcccaatgtcaaattcacagttgcgcctaacttttgaccaaccgcattggcaaaatacaaccagctcgcgttgattgttacaattatcgtgccactcactaaccataagtataaactcagccactgagccgcatttttaaatttatttagccacaccatcgtctaggtcccattcgtccaaagaattgatctcattagttggtttgacggcctgttgtgccactagttcaggggtagagacaccggtatacaccaataaggagtcaatcccaaagttaattgccgctgagatatccgtcatataattgtcaccaaccatcacacaatcgtgcttatcgagaccaatccggtcgaccgctttctgcataataattgtctccggcttaccaatgtaagttgcacgttgttgggtggcccgttcgaccatcgcaattactgaaccagcacctggcactagcccccgctcatttggaagattagtatccgcgttggtgccaatgaacttagccccccgcttaattgccagcgtagcaagttcaaatttatggtaggtcgcatcatagtctaaaccaacgattacgaatctaggtgtgcgctcatcgaacttgaagcccttttccaacattgcacccttcaagccaagttccccgatgacgtacatcgttttatcaccatcacctgcaaggtcattaacatagtctgcagtcgctaacgctgccgtataaacattcgcaggactcacatgaatatcatgattgttcgctaagtttgcagccacatcttctggtgatttagtcgtgttattcgtgaccaataaaaaatcagtctgactagcctgtagtcgttcaataaaccgtttagcagcaggaatacgttcccgaccacgataaactgttccatctaaatcaattaaataacccttgtacttacccaatcaaaatacctctctctgttcctacttttgtcgaatcgtaaagtggcgtttaccactactctgcttcgttgtttgcgcttgcttaccattaccggccgtaactttcgccggttgccgccgcttttcagtaaacggtgcggccttctgcttagtggtgaagctatgagacttccgtcgttgtttgctgcgactactgttacggttactccgcgctcgggattgccgactattagtgtttttctttccccgccgatcatccttacgtgagcgactggtacgcttaggtttaatgacccgttcatttttaatgataaaataggcgcaaccaaaattacaatattcgtacagatagtcttggaccgccccaatcgtctgtgagcgctggacatctttcatatcatcacggaaaaaaccttttaaccgtaactgttcaaaaccccaatcaccgacaatataatcatatttatttaaaattgagctgtagcgctcaacgaacttgtcgaggtcaaacccttggcgataatcgtacacgatttcaaacgggtgcttgctaacttcaaagtgggtcttatcagttcgtaatccatgatacaaattgcgccgccgttccgcttgttgttcagctagttcatcaatatgttcgcgattcacattgacaccacctttctcttatttaaccggccatcgacgcattaagtaatcgccaacgaccgttcttaacatggcttcaaataatatctcagttcgaccactgatatgaatggtcgggaaaaacggaatgaataaatcatgatctaataacgcaatctggtacgtttgttgccgattgaccggctgaccattcactagtaatgtatgctgtcccgttttccacgtgaggccctggtactggatataaccaaagacttgaccacgaaatcccattcctttaatcggaaatttgttcaaaaacgggcgaactaactccatctcatagactaagcgccacaatgcttcaccacttaacgtcactcgaataacatgcatcgcgtgaggtagcatggtatgtaaatcatttcggttgaccatgcctgcgggaagatcccgcatgaacaggccaccgttcaacatacctagatcagttttggcatagtccgtaatggccgctagcccgagggccgtcaaatcacttgcatggtgccaatgtggccgcagctgcgtcggcaccttcgcaacaacttgccgcgtgagtaacgtttcaccctgttgctcccagccagtaatcaacgtttcatcaccggccacaattggtaagctggccgtggcaacagtatgcgccgcggccgctttaacgtgatgttgatgatcaatcgtcagttcaattcgcccaatatactcaccgtattttccagctgccgctatcaggaccccatttttcagttcaccgttcaccagtaaatgatgcgtatgactgccaataacaacatcgatcaccggaaactgttttgctaaccaccgatcgacattgataccaaggtgggaaatcacgattaagacatcatattgccctgcatattgtcgtaacaactctgggaatcgcgtcttaacactggccggcgtccaaccgttcaacgggtaagtcaacgtaaacggtgccgtaaatgccagcaacaagactcgtgtcccccgtgcagttgtaatgattttagctggtaatgcccactgcggcggtcgttgcgttgcagtatctgtcaaattatcgagaacaacatcaaagttggcgcggtcatacaaccggtttaaggccgcgtgcgttaaacccagtccttcattattgccaatcgtgaccgcatcatagccaatcgcgttcaataacgccacgttggcctgcccttgagtggcttctgagagtggatgggcacgatcaaccgcgtcgccgaggtcaaccgtgatcacatggcttccagattgccggcgctgctcacgttcggttaataaataccgttgaatacgtggccagttttcaaaatgcgaatgaatatcattggtatgcagaatcgtgacttgctcgtccacggtcaatcgcccctcaatcgttgtctttgttaatcctaaagcattcaccaaagtcggtcaagcactcgcttactggcgcttggcaaaatcaatggctttaccgtcaaccatctgctcgatctcggccagtgaaaatggcgttccaaagggcaccggatggtccaagtaatcgacttctggtgtatcgacacccacgttgatgttctccttgacgttgacggcataatgatgaatatgcccgtgcaaattgataatttgtttgacgatccccatcatcattgggtagtgcgtcatatagtattggcggtggtcgtacttaatcagtacccccacgtcgtgaaattcaaacttcggttgaccattcaactgtggatcatgagcagccaaatacttaaagaaggcccgtgaatcatggtttccctttataaaaatgattttgccatttaactgtgctaagagtgcaaaaacccgctcataagacaatttcgctggtcgcgtaaaatacagcgcaacatcgcctaaatgatagactgtatcctgatccgtcacacgggcattccaatggtcaacaatcgcttggttcattgtctctacatctggaaatagccggggcgcaaagtcgttgtcccccaacaaatcagcatgataaaaatgtgtgtcggacgtaaaatattgcatcgttcaaacctcttattcgtatatttacatttgtaacatcaatcggacgtgtcatgtctagcgaatttcatgacttttgcttgaaaagctgacttatccgttcgtcagcatgtacccatgtcagtcattcgaatcctattacgactgtcagtcatcatatggcacactaactcggcaagtttatactaaacaaaccgtttccaccgagtcaaagctgacagttttggcacttactgaacagcacgtattaatcatgaaccattttaaagaacacctgacacaacgcgttagtcatttatcattgtaccgcgcaccgttctaaaagacactagaacagttttaagtttattgctttgtcagcactgaaaccatgttttatgaccaacccatattcacaaatctagctaatatcgtcaaaaagtgcacttaactgcaatcggcagagttaagtgcacttcataaatcccattagttaacctacttgatagccaatcagcactcctggttattgctgactagtcgtgtgtccgttgacgaattcggtcactaacgatcttgacaatgtataagccaaccacccagaccgctgacacgagtaacgcgattaacgtttcaaacttcagacagagaacaacagcgataaaagctaagaacactagaatgaagtaatcagataacggaaacagtggcatccggaatttcactttagcctgactgcccgcttgacgtcgatacttgatatgtgcgacgacgattgcgccccaaataaagataaaacaagtagtcgatacactcgcaatcagcgagaagacttttccaggcatcagtaagtttagaattactgacaacccaatcaccagcgtcgagaaccataacgcattgcggggaacttggcgggtcgatagtgtccccattcgtttggcaaacttgcttttgccatcatacgttagtgagaataacatccgcccggtactgaataacgcactattacaactagaagcggccgccgtgagcactacgaagttgataatcgcagccgctgaacgaattcccaaattggtgaatacttgtacgaacgggctgtgtgccgctgaaaagtattgccacgggtacatacacattagaaagaatagtgacccaacataaaacagaatgatccgcacgggaatatcattgattgctttgggaatcaccgtcttcggatcagccgtctcagaagctgtcatgccgaccatctcgatcccaataaaactgaacaggaccatctggaaggaaagcactaagcctttgattccgtgtggcataaaaccgccataactaaccaaattggttaagctggcgtggcccacaggggtcttaacgctaaacaagaccataccaatcccaacagcaattaatgccaagatagcagcgatcttaataatcgcaaaccaaaattcagtttcaccgaacgctgagacattaatagaattcaagcccagcaataaaatcaagataatcagccccggaagccattgcggtaacttaggccaccaaaactgcatatactcaccagcagccgtaatttcggccatcgcaatcgtgatccagcaaacccaatacgtccatccagccacaaagccggtcttatcacctaagtattgcttaataaaatcaatataagaatgcgtatgaaggtcagataacagtagttcacctaacgcccgcattaataaaaagcacactaaaccggtcactaagtatgcgatcaggatcgctggccccgccaagtggatagattgaccggcccctaagaacagtccggtcccaatcgtgccgccgatggcaattaattgaacatggcggctttttaagcctcgcgagagttgttccgtcgcaggctgtgaattttctttcgtcattatctttgcactccccttgaaattattatagcggccaaattcctagcattcaaaaggccacgcttaagaaaatcacacgattggactataccattgtttgctagcgaaattcatcttatgtacgcgtaagcgtttgctaacttgcatggctgggattcagctttgttagttgactaaaccagtgaacgctcccgctacgtgaataaagtgaaggcaacgcatactaacatgaataactttcacttcagcatctaaaaaggcacccggattttcatccgcgtgcctctttacaaccttaatcatattgaaacgatgctgatcactgattctgagccacgcgctcaacatcgcgggcaatcataagttcttcatcagtaggaatgagtaacgtccgaatcttcgcatcggtcgtactcaggtcccgttcgacaccactgacttgattcttagtcgggtcaatcgcgacgccaaagtaggtcaaccgatccgcgattcgttgtcgcatccgtgcatcccgttcaccgataccagccgttatcactaatgcatccgcaccttgtagctcagccaaataagcaccgacatacttaacgatccgattgacaaaaatatcaatagctaactgagcctgtgagtcctcatcataacgtgcctcgagctcctgcatatctgcagaaccagctagccccagtaagcctgactgcgtattcaaaatcgttaacatttcatcaggatcgctaatattaagctttttcatgagataagcaaccagcgacggatccacatcgcccgagcgcgttgccattgtaataccagctaacggcgtaaatcccatcgaggtatctagtgactgtccatgatcaatcgccgtaatcgaacttcccgcacctaaatgcaacgtaatcagcttcaacgtttcgagcggtcggcccaataatttagctgctcgcaccgcgacgtagcgatggctcgttccatgagcgccaaacttgcgagcaccatatcgttgatagtaatcatacggtaacgagtatagatagttaaccgccggcatacttgcatgaaacgccgtatcaaagacagcgaccgcgggcacatgtggtagtacccgcttgaaagcacgaataccgaccgcattagccggattatgcaatggcgcatattcggccagatccgtaatctgcttaagcacttggtcagtgattaaaactgaatcatggaattgctcgccaccggcaacgacccggtgaccaaccccagtaatttcatcatatgagtcaataattcgcaatttaattaactcatccaaaacgatattcacggcagccaaatggtccgcgactacggctttctcttggtaatgatgatcaacgccatagcgaatattgaccggtgaagttttgaatccaattcgttcaacagcgccctgtgcaatcacccgttcctgtggcatttcaaataacttaaatttcaacgtcgaactaccagcgttgatggcaatggtcttccccaaacgacacactcctagcgaataatattctggtcgacccacgcatcaatttgagcggtaaacgcttgaaaggcacgttgatcctcaaatgatggaaagtcgcctagtaatactttacctgcttggtgggcccgttgtccatgtttctgtaaaacaacaattgattttcgtgatttttcatcaagaaaaaggttagtcggcaagttcaacagaccttggaggtaagccgcagtgctcatccattttaacagtccttgagactcttgcgactgaaaaatcgtcgttggaacaagaaaaacaccccagccgcccggtaacaaatgagccatcgcttgctccatcatcaaatggtgaatgtaagaatgaccattcgtcgctttcgtttgaaaaccttggacacggtcatccaatgggtagtaccccactggcaaatcaccaattgcaacggtcgttttcggcatgaccaggggatcaattgcgtcttgatgaaacaactccactgctgatcgttggagatccatgctcatcgcggcgattgccaactgattatcatcattatcgactccgtagccctgaatcggacgtggccggtccgtctgcaactgatttatgaccgtagttaataagttaccagtcccgacagcaatatccaaaattgacaaatcagtcgtcgatccaactaacttagcaatcaagtatgccgttaacagtccaatcgaatctggtgtcatttgatggtttggatcaacgtgatcattatgaatcgcctttagtaaggccaactgaagcgcacgccgaattgtttcggcgtccaattgttttaagtcgatcgtttgatagagctttgttaaagctaccgtctgttccggatttggcttgccatcctcaacatgtacggattggcttaataaattatcaccagtctcaatgagcgcatccacgtaagaaacggatagttgttgcatcaaaacttgaactgattgatctaagacctgaaaaagcgtctcagtttctgcttgtgccagaatactcaccctcccgcaaaatctgtaatccttaaccatattactgattttacgcgttaagttcaagtcatggggttcactcaccaatcaagggagcgaattatgctgataagggtgctcataggattgtaaaattaagcgatataacgtctgacgagactgaaaattaacgtatcgttgggtttcaaacgccccaccaattaacaataagctaatcactgaaagcaggatcgttccgcgtcgcttcctcatctaccattgtcctccgatctggtaacagtaattgggcttgaaaatgaatccccttatcagtcgtcatcgtcagggtcaaatcatcggccacgtgaaattgccgaacgccctgcatcagattgatttcaccaccaccatagtggcgcaatccgattcgatgtaggatatgataataagtcaataaatactgtttgccggtgaccgtattaaccaaatgaacggcttttcccggcgtcagaccaccttcatcggaaatatggtccaccacaaaatggtgatccggattctcaagctcgtgaagcatcaaataccaatccactgttggcaaatccacttgggtgcgccgggccaaattgcgctgcccctgaaagagtgtcgtcagcactacgaccacgattgctaacgacacaacggcttcaattaacgtaaaaccgcgccgcctaatcatgtgcttgctccggtatcctggataatagctgctgacgttgccggtcttcatattgttttctggccgtctgaatcgcctgcaaggtctggcgttcatgtgactgcatcataatctctaaactttcaaacccaatcaaaccacccatcaatagccccagagcggtaatcgtttcaatcatcaaaaaacccattcgcgtctttaacatgtgtgactttataggccccccaccccatcaaagcattcagtttgattttctgcttcggctgtaattgcgacttgaaaataaccactgctagctgtggatgcccatttttctggatttgaatatcacgaccgcgctctgtttttaatattgcaggcagtgggagatgccactgtgggccactgataggccgcccccgcttgccaccccaagtcacaacttccgtgccacgaaagctcacgacctggggctgacccgtcacactagcggttaaggtctgttgctgccacatcgtttgtaactcccgccagaaagcctgttccgcattctgttggcgttgccgtgtgggaaaacggtgcacagcaatcaccgccacactagccacgatcgccaagaccgctaccgtttcgattaaggtaaatccctgtcgcttaaccaccaactactttttgtggttgcggccgtaccggactaatgccctgtgacttagcctgcttatattgaccatcgttaatatatcccttgttccgaagttcttctaacattgcgtcgtcatccgtgacggtcttacccgtatcattcgcatacatttcagcctgattttgaacaacttcagtcagggcttcttgttggcgaccagccgcctgtttacgttgttgattcaaattgggcaccacgatcaacatcaagagactgatgatcgccaatacgatcaccatttcaattaaggtaaaaccgcgctgtggtgctgccgtttttttcatcaagcgtttcattaataatgtcattttaaaatctcccccattgattgatacatcggtaataacaaactcaagtatgtgccgacaacgacgagtgcaataatgccaaacatgatgggttgaatccaaccaatcatccggttcaactgtcgaatcaagcgttcgtactgcaaagttgcaaagtatagtaattcctgacttaactgttctgccggactctctttgccgaccagtagtgctaactcatcaggtaataatcggtcctcctggataattgtgactaacgaagtcccagtcagtaacgcctgttcgataacctgcccttgctgataaatcagcgccttagtttgaaagtgctgactgacttcacaaatgccacgaatccctaaaccaccagtcagcagcatacccgcattaaggcttaaatagtaaccacagtagtttctgatcaggggaccaatcaaggggacttgagccaaccactgatagcgccgccgaatgggtaatcggctaacttgaaggccaaccagcaataagcaaatcaccaaggtaatgaccgtgataccgctaaaccattgccaattcgcgattgtcccactaccattaccaccatgagcaagactcggtaaaatcgcagctttgaccgtgcctaaagttcccagcagtagaattaacagcagacaagggtactgtaacaaccgccgaatttggcgtccctgttcagcacgcgctcgcattaattgacctgcctgcatcaaggtccggcgtaattcaccatgagtctcagcaattaagaactggtaatacaagtccaccgcaatgtatggacgcagcgccgtagacaaatcatcacccgcggctaaacgccccagcgcgggctgcaaggattgaaaggccggtccttctacatccaatgtaaattgaaaggcttgctgaaacgagaagccgttgcctagcaagtcggctagcgtttcaaacagcttcgtctgcatagcaatcggaagccgtttacgcttccttaagttgattggccgtcgcatgatcgagacggcccgctgccaattgttcatcaattaactccgcccacctttcagtcatcatttgcgacgttttgggcattgcatgcggtaacacgaccgtatcgaaaatcgtcgccacgctgccatccgtcactggtacgaggcgctgataggacattgcagttaaagcctgctccaaaacagcggcttccactcccaattgcgtcaaccgggggataatcccgtagacaccgcgcgcatgaatagtacttaaaactaagtgaccacttagcgctgcctgtaccgcaatccgagccgtttcggcatcacgaatctcaccaataataaagatgtcgggatggtggcgtaacccgaccttcagtaagtcgccatacgccatctgggccggcgcgtttacttgtagttgtaaaaattgtggttcataaatttcaaccggatcttcgatcgtcatgactagccgttggccacgaagctgccgcacaagatcatacatcgtggaagttttgccagaacccatcggcccggaaaataaaatcaatcccgttcgtcgcattaattgactcaattgttgccgttgctgtgggaccaaatagctcaatttttgggccggaccttcatacaataaccggacaaccaacgactcacggtccaaaaagtcgccaactgccgagattcgcaaatttaaagtttgctctgccaatgttaacgtcatcgcccctaattgggggcgccgatggtcactgattgccatgttactacggtatttgatgtgattcatcaattgctgggccaactcagttgtaatctgagtaagtgcccgcaaactgcctgctgcttgcactaacacctgatacccttctgccgtgggtaaccaataaatatcactggcccgctgattcacggctgcctgaatgatttcgttcaactctgcttcaatcaccatttatcatggtcacgctcctttcaatcattagtttcgtaacaacgaccactttccacgaaaaaaatgacatttattttggcatcaaaaaagctgttccagaaataacaaattatttccagaacagctcgtcatcgcatattttcatttgcaatcctaacatacggcgttataagcgccccgatataaaccagttaaggcgttaggcccgctcagccgcttcaatggcttccttagttggaatcgatggttgcgcacccaatttttgaacagctatcgaagatgcccggttggcaaaccgtaccgcagcggccaaattactaaagtctggcattaagaccgaactgagtgcaccaataaaagtgtccccagctgcagtcgtgtcaacggcctcaaccttataagctgggacgaagccgtgctcagcaccgcgcatccagaaagcgcctttactcccaacggtaatgatcacgttagcaacgcccagcgcctgcaacttctgtgcgccctgaatcatcgattgctcatcagtaatgtgcacgccagtcaaggtttccgtctcagtttcgttaggaacaattaagtcggtcgtcgctagtaattctgcgggcaccgtcgtcgtagctggtgccgggtttaaaatcgttttttgcccagcggcctgagccaattcaaaccctcgaatcgttgctgcaatcggcgtttcaaactgtgcaatcaaaaaagtactagcgctaattgcgggttgggcccgttcgacatcttcggccgtaacctgcttattagttccaccatcgattaagatacggttctcactactactatctaacaagatgaaagctgagccggtactagccacattgctatgttgaacatattggtcattaacaccactattcgtcaactgctgcaccataaaggccccttcctgatcagtaccaactttaccgataaaagtcgtttgggcaccagcgcgcgcggctgcgatggcttggttagcccctttacccccaccagcgacactcttaccagtcagcggtagcgtttcaccaggcttaggaaaacgcttgaaacgcaaaatcgaatcaacattcaaactacctagtacggttactttattcatgattattcgtcccttcagtattcaactgctctaattttagcaaactggcctgttcgacgcacttgttttactaatattttaagcaataaaaaacgtggttcttgatttatcatcaaagaaccacgtcttttcatcattaatctgggtagttagcagcttcgtatacttctgatacgtcgtcgttatcttccaattcatcaatcatgtgttgtaacttttccactttatcagcaggaacgtccgttaagttttcaggaatcatggttaattcagctgtttccaacttgtaaccattagcttcgagggcatcacgaacggcagctaattgtttaggatcagtgtaaatttcaaacgcttcgtcgcttgattgtaaatcgtcgccaccagcatctaaaacgtccatcaacatcgtatcttcgtcggtatctaaatcttcgcgactgatcacgatgtaacctttacgatcaaacatgtaactaaccgcaccagttgcggctaaggccccaccatgatgcgtgaacgctgaacgaaccgccgcagcagtccggtttttgttatcagttaatgcgtgaaccagaacggcgataccaccagggccgtagccttcgtaagtaacttcttcgtagttctccgcaccggagccactacctttatcaaccgcccgtttaatattgtctttaggcatgttggcagctttggccttatccataactaaccgcaattgcgcgttagaatctggatcaggacccccggcttttacagccatataaagttcacgggaaatcttttggaagactttcccacgtttagcatcttgggcgttcttacgtccttgaatgttatgccattttgaatgtcctgacatgtgtgactccttctttcatatttattttcagtttagtagataaacatacgtaaagtatgatagcaaaaaaagcgagcgatttcaagcactagaaccaagggcgtccaagttctgcgatttttattgcaaatctaatgaaccagtttcgttattggactctctttcagatttgaaatttcagtttgctaatgacaaccacaaccacgataaactggtgttatggccgtaaatatgcgtaacccacagcttgcaagtccacgattcgcaccacaccagcgggaacgaccgtcacactggcaggaagttgggccgcagtcatttgatgactcaccatggcattatggcaagcatcaatctcaacttgcggtaacgtctgttgtaatggctcccaggcaccagttgccagcgtcgtgatagcgggcccgttgaccacaaccaccaccgtactagttgaccgggctgccaaaaaattctgcacattgcttatggccgttgcgaccttagccggctcgtcgacatggactactaagttagtcattcgcttgtcctccctcgatcgaccgcagttcgagtgcgcgtagatagtgatagctactcaacatgttagcgcaggtcgcatccgtttcatccggcacttcataaatcatggtagcgtgcgggttgaggactggtaacacccgctgccagtcaatcagtccctgccctaaaggcaaactatcgtgccgcgtccccatcgaatcaaccaaatgataatgttgaatgagcggagccagccgcttcaaagccaacatggtcaattccatatcaccgtgcagcgcaatgaagacgtgactcaaatcacaaaccagcggataatgatgctgaatgatacgctcatctaactggggatcaccatacataaaacttgccgttaccccattttcaatcacgacatgtccactcgcctgacgaactaaattatccaaccgctcaaagaccacgtcacgtgcaacctgcaaggactcatactcatcaatcaagcgcccactgtcgctaccatagccaccgtgtacgagcaccttgacatccaattccgtcgccaacgcaagtaactgggccgtactcgtttgtaggaattggtacgccgcagcttcacgatgtggatcaagcaattgatcaagatgaacgccttgataactcatagggtgatgaatcacaatttgctcggtgacagttgtctttacaaattggacagctgttttaagtgtctgaaatgcttccggttcaaagtccgtggcactcgtaaaaaattcaaatacttcgggccggtattgcaaacgatccattaattgtgcgggtgcttgggacgccttcaagcctaacttaatttttccgggccgtggccgcattattagttgtgtcatccgtttaactcatcctttcacgcattccaaaaccaaaaaaggcttggaataaatattccaaacctagtataacgctatcgttctaaattatgccaacgtcactagctggcagacaaccgaacttaatcagcagacttggttgagccccgccgaacaatgccgtatggcaaggtgaccgtcttctcgtcaagttctttatcgttcatcaacttagttaacatccgcatggcaaccgcaccaatatcatataatggttgggtaatcgaggtaatagctggacgcgtgatttgggtaataatcgtatcattactcgtcacaacttccaagtcatctggaacgttgatcccggattccatacttgcgttgataagaccagccgccatttcgtcgtccccaacgaataccgcagtagcgccactatccgcaatgactggttgtaacttccgcccagcatcatatgagtagcccgcttcataaacgagggcgtcgtcaaacggaatcttagccttggttaaggcccgtttgtaacccgtcagtcggtattcagcgttgattgattgtgacaatgagcctaaagccaacgcgatcttcttgtgaccacgtgcaattaagttagtgaccacttcttcaacagctgcagcgtagtcgatattaacgcttggcgtttcattgttcggatcaaccgtcccagctaaaacaactggtgccttggcccgtttgaattcagcccggagcttgtcatcaatatggttacccataaagatgaccccgtcaacttgcttagccatcaacgtattcaacacgttgacttcttgttcacccgcatcatcggagttcgttaaaatgatattgtacttgtacatcatcgcaatatcatcaatcccgcgtgctaacgccgcaaaataaatgttggtcacgtccgggatgattaccccgaccgtagttgaacgcttacttgctaaccctcgtgcaactgcgttaggccggtaatctaaccgttcgatgacagctagtacctttttacgcgttgcgggtttaacgttgggattaccattgacgactcgtgaaactgtggccattgaaaccgccgcttcgcgtgccacatcataaattgttactgtttgtttttccatataaaaatagccctttcttgcttggtatcatatgttttcatccgttttcatgcaacatcaaccaatatagcaaaattacgcttccaatgcaacttaagattgttattgaaatcgctttcatgaaaataatacagtacttgttttcaaaatgcaagatttaccacacgaagattgttattttgggctcattattctcagctttttatcatcaacagcgctatactagtattattatctattattttatctaaggagtgtttaaattgacagattatacgaaactgcaacaagtccgtcaatggacccaagacaatcacgttgacgtgacctacatcagtaactttcacacaatttcatatttgactggttttgagagcaacccctacgaacggacgctagcactgtttgctttcgcggatgcggaaccatttctctttgcacccgctctcgaagttgaagcaatcaaggagatgggctggccttacaaagttttcggctacctcgaccatgaagatccatacgcactaattgctgatcacattcacgcacaattgactgatcctaaagtttgggcccttgaaacgggaaacttgacgttagaccgctttaccgcgctcaaacagcaatttccagctgcccacttcgataaggatctatcaccttatattcagcaattacggctggtcaaaacagctgatgaacttgaaaaactaaacattgccggtaaatgggccgactttgcttttgaacaaggatttgctgctgtcaaggcgggtcgcaccgaacaacagattgctgccgaattacagtatgccttaatgaaaaagggaattatggaaatgagtttcgacactttagttcaagctggtgaacatgccgccaacccccatggtgcaactaacgaaacccaagtcaagccaaatgaattagtgctattcgacctcggcgtcatgtatgaaggctatgcttctgatgcttcccggacaattgcttatggccaaccgagtgccaagcaaaaggaaatctttgacgtctgtctggaagccaacttgactgctcaggcagccattaaaccaggcatggcagccgaagatgtcgataaaatcgcacgcgatatcatcaccaaagcgggctatggcgaatacttcattcaccggttaggtcacggaatcggccaaactgaccacgaatttccttcgattatggctggtaaccacatgccactcgttgaaggcatgtgcttctcagtagaacctgggatctacattcccggcgtagctggtgttcgaatcgaagactgtggggtcgttactaaggaaggctttaagccatttacccatacgccaaaagaattaaaagtattagatctttaattaaaaacgtcaaagaaggccgtcacgacataatccgtgacggccttctttttttacctagcgttgactggtacttgcttttagtgttattccggtagcggatgttcggtttcataatcagccacttcggctaacagcgccgccgtcgttttcagtggcagcacgtcacagtcaaccgcggcttcactccccgcctgactcgcacgccgataaacatcaatcttatgattgactttttgcaaattcaacaaggattgatggatttgctcttcaacagcctggcgttgctcttcaaacattgctagccgttgatcaatcgttccatccccatcggcacaccaactaataaattgtcgaatatcctctaacggcatcccggtctgcttaagacaacgaatcaatgccagtgaatccaagtcttcatcattaaagacccggcggccctgcttatcacgcttcacaaagggcgttaagcccgccttatcataatagcacagtgtataacttgaaataccggtctttttggcgaccgctccgattgaatacaatgtgattcctcctcaaaagcagataggacaccgagcacttgctcagtgtcctatcttatcgctgtcagcttacttggctggtgacgattcatccgttgtcgattcatcatcagacttcgcaggtgttgcgtccttagcaggtgctgattctggtacgggcgctgaagtcttctcgtcctcgccagctttttgataagcagctccaccatcaatgacgatatcttcatcatcaccttcatcatcttcgaccttagctaattcagaccgtaaactatccgtagcttggtcaagacttgagccaaagctttcacccgtttcctgcttagcggcttgatactggtcagcaaaatcggccacttttcgctttgtatcttcaaattgttgcccagcttcagccttgaagtcttcagcagcatcgttggcatagaacgcatagtcgattgcccgatccttaaaatcggcaattccttgctgtgctttagctttcaattcagcctttttatcatcatccatcttcataacggcggtagcaatcgctgcaccacctaaaacaacacctaataagaatccctttttcgacataattaagactcctcactattattttttgaacgtcgattacgatagacatcaaaagcggctttgccgaccttgcttgcgctggagaacttgctccgcttctcattgttcttgccaatcttggctgttaagtctcgagtcgcagcatttaagtcagagacgctctgacctaagtcgcccatcgcttgaaacgctggatcaattgttgcaactttgccgttaacatcctttaagagttcattggcatttgccatgattttttcagtctcatgtgacaaggcgtcaacatcatccgtaatattatttaaactacggttgacttcccccatcgttttagtaatccgcattaaaaaaatcccgataaagcatactaataataagaacgcaatggcggcaatgatgcccgcaatgtgtgtaatcatcctaaaattcctccttcaacagccatgatattaaaactagcatagcattgtctttagtataccgcaattaaaaaagtgcttacaacattcacccagtcacatttggtcgcaataacttgatcacggcttggttgcccgcgtcaaatctgataaactagtgaacagacaacaataacgagggtgaagatatgtttaattcaattaacctagcagcggttgacacaccgactaaacaagtttcggtgtggatgaagttggctaagaaaattgactggcaacaaattattattaatattggcggcaagctactcgaaatcattttatttattttactattttgggtgattgatcggctaggaaaacgcctgatccaccacttatttttaacgaatgctaataccagtgatactgccaataatcggatttcaacgatttttacattatcattaaatatctaccattacgtcatcatgttttttggcatctatgcggtactttcagtgttaggtgttcccgtggggacgttgattgctagtgctgggattttcagtgtggcgttaggtttaggcgcccaaggcttcgtcagtgacattgtcaccgggttcttcattctacttgaagatcagattgatgttggggattacgtcaaaatcgaaaccattgaggggaccgtctccgcaatcggtttacggacaactcaagttacgagtcccgatggcacgttgaactttattcccaatcgcaagattttaatcattagcaaccagtcgcgtaacgatatgcgcgtgctgattgacctctacattctcacaacgactcccgttcaagatctgactaacgtggtccgcgaaactaatgccgacctcgtgcctcagtatcctgatatcatcggtgagcccgacattcaaggcgtcacgacacaagccgatgggacgttggtcttccgagtacaattttacgtcaaaaatggcatgcagttcgcaattcagcgcgactttttggccgcctacttgaacgcggcccgagcagcgggaattcaactcccctcgccacgtttaaatatcgccccaacgcacaagtaagctcaaccaacacaagcccgcacagcggttgctcagaaatgagcggcacggtgcgggcttgatctttcatctgacaaatttcttcaggtgggaaccatgacgcacgttgttattgtcaggaatagttttagttattcccattcgcaacctaacgtgaccaggcgaaaactattgtgcggtcacaaccaaccattaattgcaacaacgctcggcattcttgaaactcaaaaacgtactgacacgtgttagcgcagtacgttttgtaatttatttgtgtaacgcattccgatgagtcaaaaagctggtcatcgcattgaccccactcataatggcagccgtgtgcggcaccatgttttccgagtgcaacgaatatggactgtcgacccctaaccagaacattgtccctggaatctgatgaatcaaataaccaaagtcttccccagtcattgctggttccgtttcaataaagttgacatcatcatcctcctgcatgtacttgataaaatcagcagtgattgcgtcattgttctcaacgggataataaccaccttgattgagcttcaaatcgatattgcagtcataggcgagcgcaatcccctcagtaatcgtccgaacccgccgctgaatatgcatgttcatctcctgcgtcaacgctcggatcgtcccgtcaatctgggcctcaccggcaatcacattgccaatcgtgccagcagtaaagtgacctaatgtcaccacaccactttgaatcgggtccacgttgcgcgctacaatcgtctgcagctgggagactaacgccgcaccagcgacgaccatgtcgtttgcttgatgtgggtaagccgcgtgtccacttttaccacttaagtgtgcgtggatctcacaagttcccgcaaataacgtgcccatccggcaaccgatcgctccagttggtaaattaggattgtcatggaatgcaaaaatctcatctggcatccaatcaccatctagcgcaccactttcgtacaagcgttgcccacccgaggcattttcctcagccggctggaacatgaaaaccatgtcggtcgcaggtcggttctctgcaaagtagcttaggattcctagcgcgactgacatatgaatatcatggccacacgcgtgcatgacacctggatgggtcgatgcaaatggtaagcccgtattttcagtaactggtaacgcatcgatgtcagttcgataaccgattcgataatcatgctttaaaccactgactttcactaaaatcgccgtatccaaagtaggaatggttttgattgtcagccactcttgaggcatcttaccaataatcgacaataaataagcctgtgtttcatgttcttgtaagccgatttccggaatttggtgtaagtgttgataaattggaattagatcggtttcccgtaagaccattgtttatccctccaccattaaagattccgtaattctgccattaattcagtcttgctcttagtcttatcatcaatatctttcaacttacgagcaggaaccccaccgactacggtgttaggagcgacgtcttcaatgacgatcgcacccgcagccacaacggcacccttaccaacatgcacgccttcaagtacggccgcattggcaccgatcagcacgtcgtcatcgatttgaactggtttagccgaaggtggctctaccacgccagctaacacagtaccagcgccaatatgacagttcttaccaacaattgcgcgaccaccaagaatggcacccatgtcaatcatcgagccttcaccgatttcggcaccaatgttgatcaccgcacccatcatgataacggcattatcaccaatcaatacttggtcacgaataatcgcaccgggttcaatccgcgcattgtattgcttcaaatctgccattggtacggctgaattgcgcgcgtcattttctaattcataatcttcgatatttgcagcgttagcctttaagaacggttcaacatccgcccagtcaccgaataataccccagcgttgccactgaagaaagttttgatgcctgctggaacgtttaattggtctaaagcacccttcacgtatacttttacgggtgttttctttttcgcactgccaatgtagttaataattgattgtgcatctaattttgccatcggagaccctccaaaaatttatttagctttttcactagtggaaaaatccttctcaatcatatcatattgtttgccgatttcatgggtcagaaagttaaaactcttcatgaattcacgacgagtgacaattccttgaaaaatttgctgttcatcaacgactggaacaaacggattatcaatcatcaagtgtaacgtctcttcaacgtcatccacatcatgaaccgtcttaacttgtgtctccattacgtcacagacacgtttttgcagtaatatttcagtattcagttgatcaaaacctaacatttgttcagtaatcagtggcaacgatactaaaccttcaaagtgaccaccatgatcaagtactggaattttggaatacttgaccttcgttagtactaaaaacgcgtgatacaaattattatcagtttgaacgttggcaaccacgtccgccggaatcaaataatggtcggcgttacgtgacaataagtcctcaactggttgaattaacatacagcgcctccttcactaagcccatccctttattttaaccgcaaaagcactttgcacagccctaaaaatcagtttttttaccacattttaatcagcaaaatgaaattttagttctggcaccgcttgtagttgccgatcataatattggacgtcgatacctgcggctgacgttgtcacgatggcgtaggtgccaccgatacgtgcaaattcaccacgcggataagtaatactaccaggattaagcacgaccacgccgcctcgtcgttcaacacccagttgatgcgtgtgaccaaagaaagccagcgtcgcattgtgcacctcagcattagctaatagatggtccaatcccatgttcacaccgactaagtgaccgtgcgtcatgtagactgtcacctcatcaatagttggattcacttcatttggaatcacggcatcgaaatccatatttccttgaaccgtgaacatctcttgaaaaaccgcgtcatcatgcggtaattcagaatcaccacagtgaaaaaaggcgtcgacctgaccgcggtacttatcaagcaatcgaactaacacgtcacgatcgccatggctatcactcactactaaacatttcatgctttcgcccaccattcatcgaatttagtcatcagttgtcgcaaggctgcaccccgatgactgatttgatttttttgtgctggcgtcaattccgccaaggatttttgaaacttacttgaccaaaataacggatcataaccaaacccattgtcaccacggggggcaatcagaatacggccggctaactcaccgttaacaacaagtttctcaccactgggtttaagggcaaccagggtcgtatgaaaagtcgcggtccgctccgcttcaggaacgccaccaaggttggctaacaacttggcattattcgcagcatcatcatgatcaccagcataccgtgccgaaaacactcccggatcaccgtgcaacgccttgaccatcaagccggaatcatccgcaattgccggtaatccggttgcttcgaccacaaccgtcgcctttttagtggcattttcttcaaacgtgataccgttctccttaatttcaggaatatttggaaaatcagccaacgttttgatggtaatatcatacggtgccaacatcgcgctaaactcacgcgccttattggcattgttagtcgcgatgatcaatgtttgtggtttagtcattcgcttcactccctaaatcaatatgttgtgcgtgaaagtccggttggcccaaccagttccgcgcgattgcttcgaattgatcagccgcccccgtcgtgtagtactcatccggataacgcttagtagaacgatcgttagcaatatccaagtaatcgagtaccgccgaaacatcgttcaccgtttcggcaccagaatcaatcaaggtcaccccaggccccatcacattttgaataagtggccgcaataatggatagtgtgtgcagcccaaaacaagcgtatcaacgtcttgtttttttagttgcttcaacgtttccgcaaccacccgtttggcaaccgttgattgatactcattcgattcaaccaacggcacaaacttggggcacgcctgcgaaacgaccgtcgcagtgggatctttggttaagatagcatctcgataagcattactacgaatcgtcccctcagtcgcaatcacaccgattcgattgcgatgagaagcctttaacgcagcccgcgaaccaggcgcaatcaccccaataacgggaattgataactgctgccgcaacgccggcaatgccgctgcggtcgcagtattacaagctatcacgagcattttgatctgctttgccattaagaaatccgccatctgaaaagaaaaagttcgcacttgttcagctggtcgcggaccgtatggcaaacgcgcctgatcaccaataaaataaactgtttcgcgcgggagttgtttcaaagcttgcttgacgacagtcaacccgccaacccccgaatccatgaagccaattgcatgttcatttgccattttaaaatctccgttcactgaattctgaaactttattatggtcttttttgaaattgatttcaagccagaccaattgcgacgaaattgtaaagtttccgttgataaattgaaaaaaaccgacacattggtggaaacggggtataataatgattatacagtggctagaataccacgattttttgcatggaaaggaattatcatgacgaacgacttttattctcaatttgcgggcaactcgatcaaagcttccatcctcagtgtggaaatcttgcgagatgccttaataccaaagttattgggtgatgacagtagtggcatcctttactgggcgggtaaagacttggcacgccagtttcctgtcgctagtgatgatgatcttgttaccttttttgagcaaaccggctggggtcaccttgtcgtgattacaacgacggatgatctaatcacgtatgaattgactggtgagccggtcgctcggcgtagcgccacgatcaaatcaccagactttatgcttgaaactggctttctagctgagcagtcggcgctccgcaccaactgtgtgagtgaagctaaaattacgttccaaaatcgcatgcggctgcgcatctcagttacgattgatcacaatcaaccaatcgtcaatcacgatcccgcaacaccaatcgaaatcgtgcggcctcaagttgaacttgatgacgaacaacctgaagaagcacagtaaaaaggacggccacgtggtcgcccttttttgcaacgttaaatagttttccttatatagtcattattaacggttgtccccggtcttaaaaaagagcacaaaaaaacgcgccgttcacttaagaaggcgcgttcgctagcgaaccatcaatgaaataatggcccagcttattatagatattgagctaaagtttgttggatctgttccttggaatggtagccaactaaggtatcaaccacttcgccatccttcttaactaataaggttggaatgctcatgataccaaagttgctggccgtttcagggttggcgtcgacatccatcttattgaacgtcaccttgtcacccatctcgtcagctaattgttcgaccactggtgactgcatccggcaaggaccacaccatgtcgcccagaagtcagttaacgttactcctgaagccgtatccgttgtaaaagttttatcagtagttgctgcgaccattataatcggcctcctttaagctttatctgttactaatagtaagtataccagtaaccgggtggaacacaaacaatttgcctgcaatcaaagcgccgatatcgtgcacagccatgaattcgcgtcatcactgatctgcacctggcactcgtcactggttatttgaactgcacctcagtcgcaccattgccgccatgatttggcgcagcaaagtgaaacgacttgacttgccgattagacttgagatagttggtaatgccttctcgtagagcaccagttcccttcccgtgtacgattgtgacggaaggatacccggccaacaacgcagcatcaatatagcgatcaacttgagtcatcgcgtcttcataacgcacaccccgcaggtccaagttcggcgaaacgtgactcgcgtgggcactctgaacagtagcacgcgcgcgttttggctcttctggcttaacgcgttccaagtcaccgtcactaatcttcatcttcaagatgccgagttggacttcccactcgtgtttacccatctgacgcatcaacacaccacgttgaccatacgatttgaccagcacgtcatcaccttcatgaaaatcatgttgggctttggcacgccgtaatacacggtttttcttgagcttaggctgttgctccaatgcattcaacgcgcccttcgcatcaattaactcgttttctttgacagtcgccgtaccactcgctaattgtttcttacgcaaatcactaatgatagcatcggccttagtcttactttgctcaacaatggtgttcgcctgcactttggcatcttcgatcaactgatctttacgctgttgatacgcattgaattcgctcttcaactgccggtgcaatttttcagaatctgccacttgggttttcaaatgcagttgttcatcttcaacctgtttgcgcttcgtcaccaaatccgcaatcattgcgttgaggtcttgactatccgtatccgtcaacgaccgagcttgatcaacaatcgtttgcgggatgcccaaccgctgtgcgatatcgagcgcattacttcgaccaggaatcccgaccaatagccggtacgtcggcttgagtgtttcttcgtcaaactccatactagcattgatcgtatcaggtcggttaaacccatacgccttaagttctgggtagtgagtcgtcgcaacgacttgggttcccttggccccaatggcatccagaattgcgattgccagtgccgcaccttcttgcggatcagtcccggcacccaattcatcaacgagtactaaactgtgagcgtcgatctgcgctaagaaactttcaatattttccatatgggatgagaacgtacttaaattctgttcgatcgactgttcatcaccaatatccgcaaagatctcattataaacgccaacgcgacttccggcttcaacaggaataaataatcctgactgggccatcaattgtagtaatcccagcgtcttcaacgtaatcgtcttcccaccagtgttaggccccgtaatgaccatcgcctgataatcagtacctaaactaatatcattggcaacgactttgcgaggatcaatcagggggtggcgtgcttgccgtagatagacttcatttttgggtgaaacggccggttcagtcgccttcatatcatgcgcataacgcgccttggcattgataaagtcgaaatgtccaagaatcgccgcattattaatgatttcgtcctggtaaggcgcaattaagttggagagttcctccaaaatacgctgttcttcttgcttttccgcaacttgattttgccgtaaccggtcattcatcgccatgacagcctggggttcgataaagagcgtctgcccactcgctgattgatcatgcacgatgccaccaaaccgactgcgattctcggccttgaccgggataacgtaacggtcgtttctaatcgtgatgattgggtcgcttaaatacttggcatcatggccacgggtataatgacccatttggttacgaatctccgtttcagtacgacggatattgctccgaatccggctcagttctggtgacgcctcatccgtgatatgaccgtcaccttcaatggcagtagcgaggcgcttcgtcacatctggtaaagtaactaattctgcaacttcatcaaacaggtgtcgaatatcattctcaggggcatcttctagcaactcggcaaaaaagcgcgtgattgcgcgcgttgtccgtaacacccgcccaacttgcccgagttcactcccattcagggtcgcaccgatagctaaccgtttcatatgcggttttatatccgctaaacgagcgaccggaatgccaccctttaaacgatacacttctgccccgtcgttggtttcatctaaggcccgttgaatatccgcaacgctggtcattgggtgtagttcattgagtgcttgttggcctgttgccgagactaagtatggtgctaattgttgttttacttgttggtactctaacgtattcaatactttggaattcactgatatccctccgaagttccaatgaattacgaaaagccgcaaaaaaacggacaatgcaattacttgtcggcatcatccgtttgcattttcaataattcagcttgtttgtcaacctgatctgaaatcgcattgaatgcgagcaacgtcgcaatctccgtatcagacaaatcgggggctaatttttttaattgtgccacttgctcattcatcatccgcgtcactgtttgcatgtgacggtcagatgccgtgccaatgatcgtgtaagtacgaccatcaatttccgctttaaagcggcgcttgttagcagtcatcaacatcccgcttcctttcaataacaattaatattctagcatggttatcacaattatgcgacagttagaaccgtctcataatttctaaaaaagcccgcggacatgcgcccacgagcttaatctactttcgactattgcatgccaccgtcatcggctaagaaggtattcaaaacttgctcaaccatatcccattcgtcgtccgactcgatcagttgtaattcaccattgtcgccatcttcaggattaaagatgtaggcttgaatatcaacttcatcatcggccgcagcatcagctggatataataaaatataggagtgaccgaaatcttctgaatcaaacgtgaacaaaatattaaataaggtttcgttaccttcgtcatcaactaatgtgatcacatcattgtctttacgatcttggttttggctcatgttagttcctcgctattcttgtgtgagtttgccgtggcgatccaagtagttttgcaagattaaacttgcagctagcttgtcgatcacctttttgcgtttcttacgtgaggtgttagcttcttcaaccaacatccgttcagcttcaacggtcgtcagacgttcatcttcaaagtctaccggcaaatgaaaccgggctgtcagtaactcgccgtaatgttgcgccgcctcagcccgtggtcccaaggtattattcatattctttggtagccctaggacaaagcccccagcatccaattcttcaacgagttcagcaacccggtcgattccgaatttctcagcatcctcattgattcgaataatttcaacgccctgcgccgtccatccaaaagcatcactaatggcaacgccaacagttctggaacctacatctaaccccatcaacttcatgcatcaacatccttatctgcctttaagtaagacttgacaagttcctcgataatctcatcgcgctgatgcttccgaattaagttccgagcatcctttaagcgcgggatatacgccggatcaccggatagtaagtaacccacgatttgattaatcggattgtagcccttttcttgtaacgcttcataaactgtcgttaacgtgtcgtggacatccttaacgctgtcattatcgaagtcaaagtacattgttttgtctaatgaactcatatcaagcacctcccgctagtttccgcttctaatctattttactaaatgcccatatgaagtacaatcaatccactttgatgtaacacattcgtaataataacccggagaatgcagacgttttctgcaaatccatcccgatttacactgttttttcatatgctgacatacccctgtttcgaatgttcgaatagttgaagttcaaaacaggcacaccctttgtaacccaatcttctacgagttaagccggtcacaaggtgccataacattaaaaaatcagtaccgttagaacggtctcgtcctaacagcactgatttaattgttattttgatagctttaacatagctaaccaacataaaaaacaggatgtgcaaccaaagcaatcagtcttattgttcggcaagccactcatgcgcagctttcagcgccgctggtagtccagcaggcttcttcccgccagcttgggctaaggttgggcggccgccgccgccaccaccaacttttggtgcaatggctttgatcaagtcaccagctttgatacctgccttgaccttgtcatcactaacagcaactaataagttgaccttttcgccaatgaccgttccaagtaccagtacgtcagaatactgcttggtcttccaagtatcggccaattgacggagttgatccatgccagagacttcaatttgttgggcgatcaacgtcgtaccgttcacatcgtcaacttgatcaaagactgccccagcctgctgtttggctaagcgactttcgaggctggcccggttctgttgttccgctttgagatcggcttgtaactgactaaccttggctggcgtatcagctaacttcggtgccttgacttgagcagcaacttgcttcaaggtttgttcttcgccggcaagcagttcgaaagcttccttcgaagtaacggcttcaatccgccgcgttccagcgccaatccctgtttcggaaacaatcttaaatagccccaattcactactgttcttaacgtgggtcccaccatcgaattcgatagaataatcaccaattgaaacaacccgcacaattttgccatacttttcagtgaaaaccgcaattgcgcccatcttgtgaccagtttcttggtcagtttgaatagcactgactggtaacgctgcccagatcttatcattgacgatttgttcaactttagctaactcttcgtcagtcacttgaccaaagtgagtaaagtcaaaccgtaaataatcaggttctacaagtgaaccagcttgtttcgtatgttcaccgagaacgtcacgaagcgcctggtctaacaagtgggtggcggtatgattcttttcgactttgttgtggaatgccaagtcaacgttcagcgtataagtcgcgtcttttcgcattggtttcaacacttcaacggtgtgtaaatgctgcttgttgggtgcattttgtacgtcagtcactttagccaccatttcaccggcatcatctaagatcacaccacggtcggcaacctgaccacccatttcagcataaaacggtgtcttgctgaaaatcatctcagcttgaccactgtcgacgtgatcaaccagggtctcgtcaacaataatgtcgttcaaagtcccctgcacattcgttaattcgtcatatcccacgtattcacttggcgttttgatgtcgatcaagagactccgttggacgcccatggacttggcactgctacgtgcattgcgcgcgcggtcacgttgagccttcatttcaacttcaaaaccagcttcgtcgacatctaaatcttcgtcgccagcgtattccttagttagttcgaacgggaagccataagtgtcatataacttaaatgcatccttaccagctagtgtatcgtgaccagcctgcttggtttccgcgatcaagttatttaacagattcaacccatcattcaaggtctcattgaagcgactttcttctgaagccacgatcttttcgatatacgcactatttttgagcacgtcgggatagtgtgaggccatgatcttaccaacaatcggtactaattggtccaagaaagcttctttcaaacctaatttttgaccatgtaggattgcccgccgaatcaaccgccgaatgacataaccacgaccttcgttggaaggtaaggccccgtcactaatagcaaacgtaatggcccgagcgtgatcggcaatcactttgaaggacacgtcgtcctgggcgttatcaccgtagtgcttgccatcacttaattcttccgtcttatgaataattgggaggaataggtcagtttcaaaattggttttcgcgttttgaaagaccgaaacgacccgttctagccccatccccgtatcaatattcttacgtgggagtggttcgtaagtaccttcaggagtgtggttaaattgcgaaaagacaatgttccaaacttccaagtaacgttcattttcgccaccaggatagttttccgggtcatcatcagctaaattattgaaagcttcgccacgatcataaaaaatttctgaatcggggccagatgggccttgaccaatgtcccagaagttatcttcgactttaatgatgtggtctggtttcacgccagttgcttcccagaatttcgcggcatccgtgtccttgggataaacagtcatgtataacttgtcaggatcccagccaaaccattttggtgaggtcaagagttcccaagcccaactgattgcttcttttttgaagtagtcaccaactgagaaattaccaagcatttcaaacaacgtgtggtgccgcgccgtccgcccaacattctcaatatcattcgtccgaatactcttctgtgaactcgtcatgcgagggttatccggcacaacggagccatcaaagtacttcttcatcgttgcaacaccggaattgatccataataacgttgggtcatccacgggaactagtgatgcactagggacaatcgtatgacctttttcatgaaaaaagtccaagtacatttgccgaatttcactactacttaattttttcatttaattctggcatcctctctatcattcttaatttaaggcaaaaaaacaccgttgctagcaaagacgctgttaacgcggtaccactctgcttgcaacgatgtgttcgtttacctcttaagctcattaacgctgagacacggactagtttgctagtcattacttctaggtagcatctaccccacaccgcactttttccagcaaccaaagtgtttcttgaccgatatttgagatagatatgtccttactttgcaaagtatagaaaacttgtggcgacttgtcaatacaccactcagttattttgcattaatctatccggatgcacgtcaattaagacttacgatccttgcgttccttgcgggcagccgctcgttgttcgatgcggcggtccatccgcgccttatcgctgatctttttacgaatgcggcgtttgtaacccggcttgatctttttcttggactttttgacgtaaccaatcaaggttgggtccagtttttcctgttttggcccccgtttagcccgacgattacggtcatatgaatccacaatctcaccatcacgaatcgccttcggtttgaacttgatccccattgcttcaactgcactgaccttggcttcttcgcctgggctatataacgtaatcgcagtccccgccattccattccggccggtccggccaacacggtgaatgaagaattctaagtcattcggaatatcatcattgatgacgtgtgaaacaccttcaatatcaatcccacgggcagctagatcagtggcaacaacaaattgatacttcaattgttggacgtcgcgcataacccgctttcgttcacgtggttgaatatctccatggatcattgcgaccgttaaaccttgttggcgcaaataatgggtcaactcttgaactcgttccttcgtgttagcaaaaatcaacacgagatacggttcaccaatcgtcagcaagcgataaataatactgtttttatcgtgactcttggtggaaatcagccagttatcaatagtcggactaatcacagattctactggaatttcttccataactggattgttcatgtacttgcgcaaaaatggcgttaatttttgtggcatcgtggctgagaacaccaacatttgtaaatcagcaggcattcggccagcaatctggtcaaccacgttcaaaaagcccaagtctagcgtcatatcggcttcatcaactactagctgagccgcacgatgcacatcgagtgcctgggagcgcattaagtccagaatccgtcctggggtcccaataatcaactgtggttggtgccgatttagcttttcaatctgttcctgcttatcagtcccaccgacatagagtccaatgtgaatggctttcgggctgtgttggatcaactgtttagcagcagtctgaatctgataagctaattcacggctgggcgttgtgataactgcctgcacgtaacgttcatcagcattcagttgattgatcattggcagtaaaaacgtatgcgtcttaccactcccagttgctgactgaccgatgacgctgcggccagcagcaatcactggaatcaacttttcctgtaccgcagtcggtttgcggaaattgatgtcagtcagtgcctgcatcaagaacggctgcaatttaaaatcttcaaaacttgcggtcatatttaaacctctttctcataatggctagcgacttggtcgagttctcgcactaccgtttcaatttcttgttggtctttagccttggcaccgctcgctaatgcgtggcccccaccatcatggttcttggccacaccgttgattgacggtccctttgaacgtaaccgaatacggaagtcaccttccttttgttgaacaaaaatcgcccagcacttaaccgtatcaatacgcccaggtaatgggacaaccccagcagtactagcatcaccgattgcaaatgaatcgagaatcgcattcgttaaaataacgtaagctgcacccgaatccaactgtgtcagatgttcataaacgtaggccgacaaccgtgcgactggtaacgtgatggtatcttcaatacgattgacagcttcagcatccgcaccggcttccattaaggccgctgctgctcgcatggtactaggcttggtcgcagagtatagaaagcgaccggtgtccccaacgatgccggcatacaacaaccgagcggcgttagccgttagcgttaactccgccgcaaggggtgcgtaccaattataaatcatctcactcgtactggaagcatcaacgtcgacccactgtgggtcaccgaaagcgtcatcgtttgggtgatgatcgattttaacaattgtcttaccttgattccaaagttcaccatcaattcggggctgattagcggtatcaagaattaatactagtgcgtcttgatagtccgcttcggtaacctcatccatttgtcctaaccagtcaaaaccatggtactgttttccaggtgtcaatacccgcttcgcaggaaagctagctttaatgatagctgctaaccctaactggcttccgatggcgtctgggtcaggtcgctgatgacgatgaatgatgattgtttttgcttgtttaattaagtcaaaaattgctgtttggacggtcataaatgaaccttcttactctcataatttactggtggcgattaaactgtcacagtactccagtataccgaagaatccgcgtcgcgccaaataaattaattatcatttggataaagtggtaacgttaagttctcaaacgccagtggtgccaagccagttagcgtgatccctaacaggcggatgccagagttaaaatgatcatcgaccacctcttcaaaaatctcttcggcgtactgctcaaacaaggccgcgtcattaggtatgaattcaccgaacgttcgccgcttggtaattgtgacaaagtcaccgtaacgcaacttgagaacgagtgttttaccgtggcgctgatgcgattgcatgctagctgctaccaacttagcgatggccttcaagtgcgtattaacttccgtcgtcgattggagaaacggtccaaacgtccgctctttgccgattgatttccgttcacgtaaatactcgactggccgatcatcactgccgcgcactcgccggtataaaatatagcccaacttgccaaattgtttgattaggtctaattcagactgtgcgtataaatcctgtccagtcttgattcctaaatcgtgcattttaggtaccgtctttttaccgacaccccgaaatttctcgatgggttcacgtaacaaaaatggttctgcatcctgtggtaatacgattgtcacacccgctggttttcgataatctgatgctagtttggcaatgaatttgttataggagatccccgttgaacaagttaaatgtgtttgatgccaaatttcttgttgtaatcggtgcgccagttcgaccgcactatggatgtgtttcttattcgtagtcacatccaagtaagcctcatcaaaggcaattggctcaatcatctctgtatactcatggaaaatacgatgaatctgcgccgaaacttcgcggtacaacggaaagttgggcgtcttaaatactgctgttgggcagagttctaatgctttagcagcaggcatcgccgagtgaacaccaaattggcgggcaacatagttagccgtcgtcacaacgcctcgcccacctgtctgccgaggatcatgcgcgatcactaacggctgcgtcttgtaggctggatgctcccgctcttcgatcgacgcataaaacgcgtccatgtccacatgaataattttccgactcgtatccacccgaataggcgcttcaacaattgactgtgccatccgccgcccctccaatccttagtactttcattatacacgaacatacgttcaaaagcgcgtttcaagaccaaaaaataagcaaaaaaaataagcggtcatcagtaatgatcgaccacttatggtgtaaacctattttgcttcagaatcagcattatcgtcggcggctgagcttgccgattcaacttcagaagtagcagctgattcagccgctgccccagattctggtgcaactgtcttagcttgtgcatcttcggctggagaaatcttagcaacagcgttcaaatcaaaaaccaagtagatgccatcacagtctaaagtaactgttttttcggtttcgttaacttcatcaacgaccccgtgcaagcgaccaattgtcgtaaccttgtcaccacgtttgattttgcttaacatttgttgatgttgttgttgttgtttccgttgtggacggatcatgaagaagtataagaatgcgaacatgaccacgataaacagaattgatgccatttgacccatttaatatcgctcctactctaattaaaagtttgactatctttaactttaacaaattacagtctgaaataccagtagcactaaaagtttttcgggtttttatcgttaaaaccgtacatttcaaagaagttctggcgaaactccagtaaattatcatccataatggcttgacgaacttgcttcattaagtgtaacaagaaatataagttatgataactcgtcaaacgcaaaccaaacgtctcgtccgccttaatcaaatgacgaatataagcacgcgtgaaattacgacaggtataacaatcacaattatcatctaacggggtgaaatcgtgagcgtaggccgcatttttgacaactaaacgcccatgggacgtcatgcaagtgccattacgggcaatccgagtcggtaagacacagtcaaacatatcgaccccacgaattgcaccgtcgatcaaggcatccgcagagccaactcccatcaagtaacggggtttattttctggcaatagtggcgtcgtgaagtctaaaacatgattcatctcagccttcgattcacccactgataagcccccaatcgagtagcctggaaagtccaagctaacaagatctttggcactctgttcacgcaagtctttaaagcccgcaccttgaacaatcccaaacaagccttggtaatcaggatgttgatgaaccttcaatccccgctctgcccagcgacttgtccgggcaactgacttgctaacatagtcgtaactttcaaagaatggtgggcattcatccaaactcatcatgatatctgggccaagatcattttcgatttgaatagccttttcaggagataagaacatctttgagccattcagatgattcttaaagtggaccccttcttccgtaatatcacggtttttagccagggaaaagacttgaaacccacctgaatccgtcaagattccctttttccaattcataaactgatgtaacccgccagcttctttcacgatttgctcgcctggccgtaaccacagatggtacgtattcgataagataacacccgcacccatcgcgtctaattcttcgggtgccagtgacttaacactggcttgcgtcccaacgggcataaacatcggtgttggaaaggtcccgtgtggcgtaatcaattcgccaaggcgggctcctgtgtgtttttctttcttaattaatcggtatttaattgccggttccatatctgttcctccgtattaaaatgttgctaaactcaaataatgatagcacgaaatccagccgtgaaccagtcgcggcaattggcgtgggcacccacgtggctttagtcagtctgttaacaaagcgttcaaacgtcaaatagtcgcctcaagaatgcattttaacttcttgaagcgactattgacaatctttattatctccagagctaaaacggcagcttgaaattagcgatacgcctcgtataatacggcattttaatattcaaccgtcgtccgtttcaaaataagcgatcgcgtttaaagccagttatactagtgaataaacatcgcatcgccaaaactgaagaagcgatacttttcatcaatcgcatgttgataagccttcaaaatcatatcacgacccgtaaaggcagccactaacatgaccaaggtcgacttcggtaaatgaaagttcgtgatgaacgcatcaacgactttccattgataaccaggtttgataaagatatccgtccaacccgaatccggcttgatttcaccatcaaacttactaccaatggtctctaacgtccggattgacgttgtcccggttgcaatgatgcgcccaccattttgccgtacttcattcaacgtcttagcagcatcttcgtccaatcgataaaattcactgtgcatcttatgatcatcgatattatcttcttcaactggccggaacgtccctagtccgacatgcagcgtcaagtaaaccaacttaatacccttgtcttgaactttttgtaagagttccttcgtccagtgtaaaccagctgttggcgcagctgccgagccattttccttggcataaacagtctgataacggtctggatcatcgagtttttctttaatatatggtggcaatggcgtttcacccaggctctccaaaatttccatgaagatcccatcgtaatgaaactcgatcatccgaatgccatcttccttttcggccgttacggtcgccgtcaacttaccatcgccaaatgagatcacggtaccgaccttggcacgtttggcaggtttcatgagtgtctcccattcatcaccttccgtattatgcaataataggacttcagcgtgaccaccagtttcaggtttaacaccatacaaacgagctggcataacgcgggaattattcataacgaccgcatcgcctggattgagttgatcaataatatcgtagaaatgcttatcttgcatttcgcccgtttggcgatccaattccaacaaccgtgaactatcccgttttttgattggtgtctgggcaatcagttcatgtggtaaatcataatcaaaatcttcaagtgttaaactcatgttgtgacctcttatctttatttattttctgggtatgggaatcccaaatgctgataacctttaattgtaacaacgcgtccacgttgtgttcgcttcaagaacccaatctggagtaagtacggttcgaccacttccgcgattgtatccgtttcttcaccaatattggccgcaatcgtagcaagcccgaccggacccccgtcataatactctagcatcgttcgtaagagcttattgtcagtctcgtccaagccggcatcatctacgcgtaaatatgtcagtgatcgcgccacgatggcctcatcaatggcgtcttgatccgccacttctgcaaaatcacgaattcgcttgaacaagcgattagcaatgcggggcgttccccgtgagcgacgcgcaatttcgtgggcacccgatggtttgatactcgtttgaaaaatatctgcagtccgcttaacgatatcctccaaatcagcaacttcatagtacgccatatgttcgacgattccaaatcggtcacgtaacggagctgacagcataccagcccgggtggtcgcgccaatcagcgtaaacggcggcagtggaaagtgcacgggatgggcggttggcccctgtccgaccacgatatcgacaaaaaaatcttccatggccgaatacaacatttcttcaacgattttcggtaaccggtgaatttcgtcaataaataagatatcacccggctccagttcattcaagagtgcgaccaaatcacctggcttttcgattgcagggccactggtcgtgcggatattgacctgcatctcgttggcgattaccatcgctagcgtggtcttccctaatcccggtggaccatacagcaaaacgtgatccaaggattcctcacgcttgcgggccgcttcaatatacactcctaattcgtgcttgacccgggcctgaccaatatactgggctaacgtttgcggacggagcgatttttctaatgacgcctcttcgtcatcggctttgtcaccggataataacttgtcatcgtccatttagttacccctcccatctacttcttcatcaatagtcgtagtccttcactcaacaaggtgttcgtatcggccccttgtgtctgactagacgtctccaacttcttagtgaccttcttgacatccgctttcgaatagccaagagcttccagagccgccaacgcgtccgctaacgcgccatcaacagcaggagcatccacatcgagcgcagtttgaccagtcacatcaacgtttagatcgtttaatttacctttcaagtccagcacgatttgctgagctgtcttcttgcccacgccaggaaaactcgtcagataagtcgcattctcttgattgatggcttggatcagacctgcatggtcgttgttggccaaaatcgcgagggccgacttcggaccaattcccgaaaccccgagcaacttttcgaacaacgccttctcgtcagcatcaaaaaagccaaataggctcatgccattttcgctgacggcttgatggatatacatcttaactgctgttgggcccacctggtaacggtatggattagccgttagcactttataaccaatgccgctgacctcaatcaccacataaccgggggttacatcggtcacttgaccgagaaaatattcgtacaccgaaaaaactcctttaaataaaacgtatgtttgcttgctaaattgtaccacattttcacagtggcttaacactggtgcaccgataaaaaccaaattttaatgttaaatcaatttcacctcgattgacggatttcgtggcaagaaatgcttgccgccacgttaacgtcatgctatgctcaaagtcctagggaggtctcgctatgcaactcaaaccgtttaaagcggtgttaccgaccacaactggtcaaactaaaattcaaacagctgcgaccaattgggacagccaggatacaatgacgacaaccgaagccagctattactggtacgaactcacactcaacggtgttcaccagtggcgcttaattggcagctggccggtggatcaaaccgtgacgaccatggttcccggcacgatcaacacagtcctttacccacagcaacccgttatcgagatgttgattgacgactgggtcggtcattttgccccggtcgtcgaggtgacggataccgcgcacgtcacacatcgactctggcagattactgagtctgaggtcaataccgacatcacaacggccatggcacccgttatcccgcagaaaacgtggttgacaacggtcagcacgccactcgtcatgttagtctcaaccagtgaatggcaaaaattagccactgcaccggtcattcccgaacaattaattgcgttagcgacacctcataattaaccagtcgtggctgttaattgtgagtttcgctatggcatacattcgtttgtgttccatctaacgttaaataggcttcttaggaatcaaagttaattcctaagaagcctattttaataccgatttactcaattaagattgtctgacacgtttgtgaagcccccaccagcaggcaatcagtatgctaatcacaccaccaataatactcgaccatatgccgatttttagtcctggtgtgtgatacgtcaaccgaatctggtgccggccggctgtcaacttggcccccacaaaccctttgttgacgacttgggtcctaacggtttgaccgtcaactcgtagctgccaaccagtcgaatacggaattgacgttgttaacacggttgctgtcttagtcagcgtggttcccgtaatctggttgttcgtcacttgttgatgcttcaacccactggtctgtagttgccgcgtccgttgacgataagtcttcccaagcggtacagcgatcagtttagcggacttaaaatgcaaactacgaatgctcgtaaagttcagcgtaatcagcttacgcgcgtacttgctataccctaagttgattactgctgatgtccggggctcatagtctgacatattcgtggtacccaactgactaaaactcgtcaagttatccgttgtctgagcagttaaagaatacccactagcgctcaaattgcccttcagaccatcgcgaacatcatctagataatcgaccttggtatacggacgggccgtgaacacgttggtgttttgactcgttgtcaaggcgtgcttgattgaggaacgccgataactgatgccatctagcacaagatagagttccgtatttcgatacttcttagggtgttgaatggtcaattggtacggtatctggtgcccctgcacatcactgaccatgctcgttaactcgtcggcattgttttcctgatttttctggactaacttttgattagctgcaatcaagttcaacacgcggtttgacggtgtcgtcaggccagttgccggcgtcaaactttctcgttgttccggcgttaatgtgatcgtatctgccggtaacttagtcaacgcgttgttcgacgctcccgttgcatgttgattgcggtaaataatcaccttgtccaacgtatccaaaacattcgtcgtatccgcttgaaccgtataagcgacgttttttccggtaacggttggcttaacagtcttaacaccactaacctgctgcgtagtgaccgcaccttgtaacaaggcttgctcgcggtcaactgcgttcaagcgattaaattggcgttgactaatttgatgctgctgtgtataaactaacggcaacgcattcttggattttaacaagatcgtgccggtatgattactcatgccataaataaacttgtccgcaaaaatcttcggttcgccagttttcatcttaacaacctcatatccggctggtaaggcttgcttcttcaactggtcctcacgtgcaaataaatatttaacacctaataagttatacatcgtcgtccgaccgtccaacgaaccgagtggcgagttcatcgcatactctgagttgcctaaggcctgactaaatgcccccacgtaaccattttgaactgaaaaatacgatccaaccgtgtgagttcctaacaccatcggcacatcactctcagccgaacgcatcgtatagtagttgggtgccaaagccgttcgataaaattggctagtcgtggttaaacttttttgcgcgccatcaaaataatttttgacccatttcattgccgcgccctgccgcaactgctcagtactattagaattagtattgatactcaaccagcccagtccgttattcgccaggttcagcgtgacaattcccagtaataacacataaaattgccgattggtcaattttaaggattgtttggccagcaggaccccaattaacgctaacaagatgagatatgtcgcaatatcatgtttgcgaatattgagatagaatccattgatcagccaaataatgacaagcagaccgccactaataccagccaaccattttaaatcagccgctgtcagagcagtgacttggtccataaatgccatcgtcgcataagcaaacacgagggttgccatcaacaaccatcgattagaaggtgttgaaaaaacgtttaatacggccgcaaattgaggcaacaaaatacccaacatcatcacgaccagtacccaattaagcacccaatagcgtctgaaatgacgtagtgtataaataattgcaataaagctaatgctactcagcccgagggtcacccagtattggacactgccaccattggtcaacagtcgattgggtaaattaacgtaataattgatgggataacttgtcaagccattcgcaaagttaaaactcgcacgcgttgccgtcaacatcgcgagcagcgtgggcactagtaagatgcctgccatcgtgacaccaagaccaaccgccactagtaaccgccaaaataactgtccaaacgaccgcatcgttaaatgatcacgacgacgtgaccagaaacgcaccaaagcatagactaagccgcccaatgcgagtaagtaagcaaaatagaagttactcaaaattacaacggcggtaatcagactgagtggtaaccaatgtcggcctcgtaagacccgttcaatcgcccaacacagtagcggaaaccaaatcattggtaacaagaaaaacgggtggtgcatcccaacatagaacgtatacgcggtaaacgtatacgtcaaagctccaatcaattgactgacacgtttgaacttgaactgccgactgaaacctagaaaagcaagtccaacgaagtacaatcgcagcaagatcaacgcttggtaggcccattccaaatgagcgcgcgaaacaaacgccactaaataattaaacggatcaccgaccacgtagtaggaaaaagtcgtcagttgatcggcccccaagccgagattccatgaccaactgaataattgttgtgggtggtgctgtaagatccgctgaaattccaataaaatcgggaagtgttgggcgatgccatccacttcccaaatcaatgtccggccggctaagaaaagcccactgtaagtaatcgtcgcaataaccacaaacatcgccgtataccagacgactagtggtatcttccgtactgtcttcaaatcaggtgcccctatcttgtaattacgtcgacaacgcaatccccatattttgccatctcaaacaatgtttctattttaccatgaacaatttcgtctcgtgatgttcagtttgaatcttaataaattcgtgattcacagctgtcccatcaacaactaacgccaatcccagttatctaaagtttcaatcttagtagtcgccggataactcccaaacaactgtactaaaggttgtaagccactcacagcattatcacgttgtaagttgatcgtagcgattgccgcttgatcatgacggttaggatcgagctcaaaagcagcaacttgctcatataaattcagcgtaatcaatttggcgtcccgcgcacttggatgcgcatttaattcccacagcgtcttgcgcccggccacgaacgtgggcgtggcctctggtaaatctgccaaaaaacaatatgccgaataaacctggcgataataaagtttggtcatatccaaaacaatcaactcccaatcatgttgagtggtccaagcacccgatacgcgctcaccactcattttaatcaatgatagctaactatttaaaccaattcaatctgaaattttacaactcaaattagtgtcacaaacgccactttcccaatcttaaagttgttttttagaccgcaatactggcgacaataaaagtgtccctaggttttttaacccagggactactcaacattgctatttttattcgataacacattcggttcgtgattattcagtatcagtcatgattaaaacgtgccatttcttaagttcaaaagcaaccagcttaagaccgctggaaaaagttcggactagcgtagacttgcttggtgtgtgcgccttacaccgacttccaggcatttctgccaattgccggaacgtggtgggcacagatttgagccgaaaaatcacgtctcaaatactggcctttcactaaccaagcacaagacgcttgctaagtgaaatttcaccactgagcattggccgaaacgccttccagtcgggacagtattcgaatggctgacatggatgcaccaacttttgatgaattggtcgttgctttttataaacgataattttgttaatcaactgtcagactgaaaataatattgagatggctcactaatcctgaatcggtatagtaggatttaatctcttgacagagtgcttaatgcacctagcgctttgtttaaacttccagcatcaaaatagtcagcgactaattgtaccaaattaggtggtcgttcatcagccattcgagcagtttcccgaccggaggggctgggtggacaatgctcagtagccaaattattcttagctggaagtggtctgcttccggcttagaataagactcgtatttgagatgacgcgggttatgcgttagctcaaatcgacgtcggctgcgttccagcaattgtcacccagccccggaggtcggcataggacgcacaccggctgacgaacaacaatctaaacttggcacgttttaatcataattcatgaaatatttacttgcacaatgcggatcgattacgaatcatactaaagtaacgagtacgccgccaataatcactttaatcacgtgcttcatgactatcctgaattcgtttgaacattcgttccatgtctgaattcgtgaagtgtaccgtcaccggacggccatgtgggcaattgaacggattctcgcaggtcggtaacttggctaataacgcgcgggcctgctgatcatccaaatggtgattggccttgattgcccgtttacaggacatcatgatagctgacttttcccgaaattgggcgaccgtcaacttatcatcctgtaagagccaatcaatcatttcacgaatcgtatcttcttcttgcccagctttgaaccaggtcggatgggcatgaacaatgaagctgttgccgccgaatgattccagatgaatccctaattctgctagtaacggcaatttttccttgatctttaaaacatcgctcgtcgggtaatctaaaataatcggaaccaataaattttgttgatccgcactaacctcacctatcgcttggcgataatattcatagttgattcgctcctgggccgcatgctgatccaaaatgtacataccgtcatccgcctcagctaacagataagtcccgtgcatctgaccaagatagcgtaactgtggaaaacgttccgtatccggcgcttcactagtcggcgcgcttgcagccgtgctggtttctaacggttcagcagtttcaccaaagggtaaagcgcctgattctgactggtaacgctggtcaaatgcttgaactggagtagctgtcagttcgtcgcgatggctaatcataatcggctggttggcagaacttgccgctgattctgacggaacaaccgcactaactgctgcacggtttaccgctgatggctgtgctgaagtagtacttaccatggtcgttgccgagctgggctgcatggttgccgctgccagcgaggctgcaaactgctcagtcgatgccggcgttgtcttatccgctacttgatactgtgacgaaacggcgttcaaatccatcgccagctggtctgtatttagatgttcacgccgatggctgccaagattggtcaatgctgacggaatcaagttcacatccactaaccggtccgtaatcgtggtgctgaccagtttggctaattctggttccttactcaaacggacttcttgtttcgtgggatgaacattgacgtccaccaataaaggatccattgttaaagcgatcaccgcgattggataacggccgaccatcaacttagaaccgtaacctttgatgacggctttggtcaattgctggttcttgatagcacgaccattaatcagaacagtaatatactggcgactggcccgcgtcagctcaggtaaagccacaaagccactcaatttaaaatcagtggtcgatccttgaatggcaaccatcttgcgcgcattttggacaccgtaaataccagcaatgacttgttgtaagtcaccgcgaccagccgtttttagtagctctttcgcattatgaactaaccgaaatgccaccgctggatagctaagtgcgatgcggttaaccacgtctaaaatattcgctaattccgtttggggggacttcaaatattttagtcgcgcaggtgtattaaaaaacaaatcagtgacggtaatgtccgtcccttgccgcaatggagcgggcgattgttgtaatagcttaccgccgcgataatgaatactcgtcccagtggcgccggtactcgtattcatcaccacgtccgctactgacgcaatacttggcaacgcctcaccgcgaaaacctaaagaatggacgcgaaacaaatcttcacgtgatgtgatcttactcgtcgcatgccgtttaaaagcggtcaggacttcagcgtcatcaataccgtcaccgtcatcgataacccgaattgactgaacacccgactcttgcaccaaaatatcaacctgcgtcgcgtgcgcatcaacagcattttcaaccagttctttaacgaccgaggcgggccgctccacaacttcgccggcagcaatctggtcggccagcacagaagataactcatgaatttttcccatttccatcggtcctttcacataaaataattaagctcgtgtcctgcacgaacattttcgattaccacaactagcaataactgactagtgtcgacctacctgtccgtcagacgcaccaatagctcatcataacagcttattgcgctcatttatgatgagttaaaatgcgcctacttgcctaatctttgttgccatttatacagctggttcattacatccatcggagtcatcgccatcaagttcaacgtcttcagctgttgtaaaaccttttcacccttcgcatccgtcaccgccggctcagcaaataacgacagctgttcatcaccggcttcagcgaccggagcttcggcaactggggtctccgattctactggctgtgactcatcggcggcctcaaccggcattgaagccgctgtgttaggtgccacgctattagcagcatcactagcagcaatcgaagccgctgtcgtcgataccgtactcgtttgattttccaaactcgttaaaatcttattggcccgttccaataaactcgttggcatcccagccaacttggcaacgtgcaccccgtaggacttatcggcggccccgggctcaactttatgcaagaagacgagctcgccatcctgttcagtcgcacccacatgcacgtttcgtaacccggataattcttgatctaacgcggtcagctcatgataatgcgtcgagaacagtgtcttggcatgaatatggttatgcacaaactcaataattgcttgggcaagcgccatgccatcgtaagtcgccgtcccccggccaatctcgtcaaacaacactagactattggctgtcgcatgttgcaaggcattattggcttcctgcatctccaccataaacgtactttgaccggaaattaagtcatccgtggcaccgatacgcgtaaaaatttggtcaaaaattggaagttgcgctgatttagccggtacaaaacaaccaatttgcgccatgatgaccgtcaatgctaattgacgcatgtacgtacttttaccggacatgttaggaccagtaatcaaaaggaccgtctcatcaggtgacattgtcacgttatttgggacgtaactctggttacccatcactttttcaacgaccggatgacgaccatcaacgatcttcaaatcatgtgatttagttaatttcggtcgaacaaagtggtaatcttcactaacgacggcgaaactttgcaagacatcaattgctgcgaccgccttcgccaatgtttgtagccgctgaattgcctttttaaccgtttcacgaacctttgtgaagagttgatactcaagatccgtagaatggctctcagcttctaaaattaggctttcatgcgatttcagttcaggagtactaaagcgttcagcattcgttaacgtttgcttacgttcatagcggtccttcggtaattgggccaagttggccttcgtgacttcaatataatagccgaagacccggttaaaccctatcttaagattcttgataccggttgtcgcccgttcctgggcttccaactcagcaatccattttttcccattattcatagcatcccgatattgatcgagttgctcgttataaccatccttgatcacaccaccgtccgttactgacaaaggcgcgtcttcaacgattgccgcgtcaatcaaatccgcaacgtcttcgactggatccagctgattaacttcatcattaaatacctgcgtatctaattccgataagatataccgaatctttggaatctgacgcaaggatgtcttgagttgcactaagtcacgcccattcacgctaccaaaagccacccggccagctaaacgctccaagtcataaactttagtcaactcttcttgtaagttactacgttcaaaataatgatctaataacgtcgcaaccttattttgacgcgtttcaatatcggccttcacaatcaatggccggtcgatccactgctttaatagtcgtccgcccatcgccgtcttagtttcatctaatagccacaggagagttccctgctttttaccagttcggatggacttcattaattccagattatacttggaattatgatcgagtttcaggaagtatgacggctcataagcgatcgccttttgtaagtgcgcgaggctccgcttttgagtcaccgtaatatacatcaataaccgttccacgacctgttgttccaaatcgaccgtcaagtcctgagtcaagtagctcaattcagcctggggggtgacgttattctgctctgaaattagaattcctagcgtcttaatttgatcgcgcaaatcgctagcaacagagtcgtcgaccacaatttctttagtttgcaagctggtcaactcgttaattagggtatcgttagtcgttaagacactcgtttttagttccccagtcgacaagtcggcgtacgcaaaaccatattgttgatcacgctgaatcagcgcagtcaagtaattgttcgtcttagcttgttccgcgccccgttccaacgtcgtaccaggtgtcacgagctgaatcacttcgcgtttgaccatgcccttggctaatttgggatcttccatctgttcacaaatagcgactttgtaacctttatctactaaaatatcaatataattttgcacggctcgatggggaaccccacacatcggtatggggttttccgccgaatgattccgcgtcgttaaggtcaactctaataactgagcacctttaatcgcgtcatcaaaaaacatttcataaaaatcaccaagtcggtaaaataaaaacgcatcgggatattgatttttaactgcaaaatattgacgcatcatcggtgtatcttttgttttctgtggcacgcttaatcctactttctatcgtaaatcttagtcatcaaaatatgggtggtccggattaatcaaaatccgggcaatctttttcgcccgaccactctgaccatcaacgtcgatcacacaacccgacaacactgccggactatcctcttgcacgttgaaacgggtcggcatttgttccaagaaacgctgaataacattctcacgggtcattcctaaaataccattatacggacccgtaaaaccaacgtcacttaaaaaggccgtcccatttggcaatacgcgttcatcactcgtctgcacatgggtatgggtgccaactaccgcactcacctgaccatccaaataccacgccatggcttctttttcacttgtcgtttcagcgtgaaagtcgatgaagatgttaggtgtctcttcccgcaattgctcgaccaatggttggacagtcgtaaaaggatccgctaaattttgccccataaagacgtttccttgaagattaatcacggccaacttcaccgtattgaccttcacgatcgtataaccaacccccggagtcgtcgctggcggaaaattcaacggtcgaatcaacttcttagcaccattaataaaatcaaaaatttcattattatcccaggtgtggttgcccatcgtaatgacatcagcccccgcagtcaagatgtccttatacacttcctgattaatgccgcggccgcgggtggcattttccccattaacaatagtaacttgtggcttgtagcgccgttttaacttaggtaagtacgtggtgaccgccgtttggccgacattgcccatgacatccccaacaaatagaattcgcatagattgctcccttgttttaacgttataccaattattttagcattatttagccttgaaaacgtgattgaattctgctggcaactaaaaaaatgagcttaggtcaagacctaaactcatttcccggttatttagcgtaatccactgctcgaacttcccgaataaccgtaaccttaatatgaccgggatattcaagttcattttcaatctgctttttgacatcgtgcgccaaaaccgttgcctgtaaatcagaaatctcgtttggcttaacgatgactcgaatttcacgaccagcttgaatcgcatagctcttcttgacgccatcctcattattagcgatcgcttccagcttctcgagccgatgaatataattctccagcgactcactccgagcacctggccgggcggctgaaattgaatcagacgtcgcaaccaacaccgcgataatcgacttagcttccacatcaccatgatgggaggcaatcgtgttaatcacgacggggctctctttgtacttcgttgttaattccacgccaatttcaacgtgggaaccttcgatctcatgatcgacggccttaccaatatcgtgtaataatcctgcgcgtttcgcgagtgtaacatcttcaccaagttcagcggctaaaacgcccgctaacttcgcaacttcaattgagtgattcaaaacattttggccataactggtccgataattcagccgaccaacaagcttgatcaagtcaggatgcatcccgtgcaatcctaaatcaaagacagcttgttcaccagtttcacggatcttttcgtccatttccttacgcgctttttcaaccatttcttcaattcgagctggatgaatccgcccatcttgaatcagcttttcaagcgcgatctttgcgatttcacgacgaatcggatcgtaaccacttaaaacgacggcttctggcgtgtcatcaataattaaatcaattcccgtcagcgtttccaacgttcggatgttacgaccttcccgaccaataatccggcctttcatgtcgtcattcggcaaagaaacgaccgaaaccgtggtttcagaaaccatatcggcagcactttgctgaatcgcttggacaattaagtttttggcttctttttcagactgcgctttcacttcgtccgtattttctttaattaacacggcccgttcatgcgttaattgttcgcgcgtttgggtcaaaatctgatcgcgagcttgttcttgcgacaaggcggcgacccgttctaactcagcttgacgttgcgtgattagtgaagctgcactttgttgctgttgttcaacgcgtttttgctcattggcaatcttatcttcttttttacctaaagcatcctcgcgcttttcaaaagtattctctttgtgatctaaagtttcttcacgttgaagcaaccggtcttcttgcttttgaacttcattccgacgttgctttaactccgtttcaacttcagcccggtagcgatgactctcttccttagcttcaaggactttttctttcttatgagtctccgctgcccgtttggcctcagaaataataccttcggctgtgttcctggcaacgtccaattctttttcatggacgttcttgcgtacatagtaaccaatcccataaccgacaacaattgcgatgactgcgaggattataccgaaaacattcatgtttccacctccgcaccaccaaaatccagttaacataaaatcaactacaaattttcagatgttatattttgattatttacacacttgttattctaatgttagaaacgaatagtgtcaacttaaagtcttatggcaaccgctctctgcaggctacttttgtcgtgcaaacaagctaagtatgtacaaaaaacgcccaaaataaatattttgggcgttgcataacaaactgtctatttttcggttggttggtcgccgagatcgagagcagtttccgctggtgtcgctttagtggacttactttgacccttactgccattcttagcagttcccttatccttagcttctttggcctgatcatcagtttcagacgtttcttcaccagttgcatccataccgtatgcatcacgaaccttttggcgaatctccgtcatgacatcaggatgctcgtccaaatacttcttggcattttcacggccttgaccaatgcgatcgtcaccatatgaataccaagaaccactcttcttaacaatatccttttcagcagccatatcaacaatttcaccagtttgtgagataccttgaccatacatgatatccacttcggcacgcttaaatggcggtgcaaccttgttcttaacgactttgatccggacacggttaccaataatattggttccttccttgatctgttctgcccgccgtacttccaaacgaatcgtggcgtaaaatttcaaggcccgaccaccaggagtcgtttcaggattaccaaacatcacaccaactttttcacgaatttgattgataaataacgcgattgtcttggttttgttcaatgtccctgataacttccggagcgcttgtgacatcagccgcgcttgtaacccaacgtgtgcgtcacccatttcaccttcaatttcggcacgtggcactaaggccgccaccgagtcaacaactaaaatatcgaccgcaccactggaaactaaggcatctgcaatttcaagcccttgttcaccagtatctggttgcgaaagtaacaggtcatcaatgttgacccctaggtgttccgcataaacggggtctagtgcgttttcagcatcgatataggccgccgtaccaccctgcttttgaacttcagcaaccgcatgtagtgccacggtcgttttacctgaactttcaggaccgtagatttccacgatccgaccacgtgggtagccgccgacacccaacgcgtcatctaaggccaacgatccacttgaaatcgttgaaatagtcgtctgggcagcgtcacccatccgcataatcgcccctttaccgaaattcttttcgatctttttcagggcagtatctagtgctgctttccgtgcatcagccaaattatttcctcctttggtgctcgtttctaactcttaatatcatagctgttcaaagttagaattgcaagcaaaaagcgaacaaaagttcgtattatttttttaagtccgtatcttcattcaatgcatgtctcaataggtctaacccggccatcacactgcgttcccgaatttgttgtcgattaccagcaaaatggtactgcttggccttcacgggtcgatcacggtaagcaagaccaatccataccgttccagccggttgaccttccaaggttcctggaccggcaacgcctgtaaaactgataccaacatcagtatttagctgctgcttagcaccactcgccatggccttagcggtcgcttctgaaaccacgccctcagcgtcaataattgcttgtggaacgttcactagctgatgtttggcctcattcgcatacgttacaaagccgcccggaaagattgcggagaccccggacacactgccgatggtactctgaaacagcccagctgttaagctttcagcggctgtaatactcagcttagccgcaatcatttgattaataacagtagtaactaacgagttatcgtctccataaccgtaaaagtacggcccaatggtagccttgatctggtggtcaactttgtcgatcattccccttgcagccgtttccgtcatagcttgggcacttaatctgagggtaacctcgttagtcttggcatagggtgcaatcgtaaccgcctgctgttcatcaatcaagggttgcaaccgggtcgccaattcagactcactgatgccataaaaacgcatcactcgcgaatagatttgggcttgttccccatatgcagctgccaatttcggttttgcctcagaatcaaacattacggctaactcacggggtggacctggcaataacaagaaatcagcactattttctgactgataaaacgcaccaacagccattccgctatgattagtcaacggttgcgcgcctgccggatacaatgcctgtaatcggttgttggccgtcattactttgtcattagtggcaaaccaggccgtaattttttgcattgctgcctgatcttcaaccaaggcaacattcaaataatgcgcgagcgtctgcttcgtcaagtcatccttggtcggccccaaaccacccgttaaaataactaagtcattccgctgggccgcaatttcaatgacggtcgacaaacgttgccgattatcaccaaccaccgtttgataatagctatcaattcctaattcggccaatccacgtgcgatgtacgtactattcgtgttcgtaatctgacccagtaaaatctcggtaccaaccgcgattatttctgcttgcatgccatatatgcctccccgtaatcctatcgattacactcagtgtgggcgcgatgattagcgtcctacattaagtatatacgaaaatgacgatcgaccccattaaaaagattagcattttcaaataccttcatttgacataacctgccaacgcgactcatcgttaaaattatcgactgacaggagtcatgattaattaataagggcaacacgttaatggtatacaaaaacgtctcaccgaatgcaagactcggtgagatgctcatgattaattttatttgaagccatctgcaaacacgtcacgattctgaacaaaataatcaatgccagaataaataacgaagaataagcagatatataacataattgccgcaaatggaatgtggattgccgcaaataagacattgttcagcagcaggaagatgatggcaatcatttgtgtcgttgtcttaatcttcccgggcatagcagcagccatcactttaccattattttcaacaatcaataatcgtaaccccgttaccgcgagttcacgacacatgataatggcaacgacccaatcaggggccgcatttaaccgaactaagatgatgaacgcggtcattactaacatcttatctgccagtggatccgcaaacttcccaaaattcgtaaccaagtgttgaccccgggcaatcttgccgtccgctaagtcagttaatgacgcaaccgcaaaaatgacagttgcaaccacttgggtgactggaattgttgttccagcccacacaacctgtccccaactaaggggtaacaccataataagaatgaaaactggaatcagaataatccgaaacaccgttaatttattaggtaaattcaaagtacccgcctcctccgcaacgttatttgatggtcaaggtaatcgtccgaacttgtgacgtactgttcttcggattaaaattgaacgccttaccattgattgttacggtcgtggcagttgcgttcccaaactggaacttaaccgtcgtagcattacttggtaacgttaatgtatgtgagccatccgcctttagcgttccttgccaagtctgagtaccgttagtcgtaacggaagtccaagcagccttagtagacttgatgaccactttgttcttatccgcaccattcgtcaaagtataagccgtatcgctactgccgttagccttgattgtttgttccttggcagaagacgctttagaactagactttgctgatgaactagctttcgacgaactcgattgcttcttagaactcgaaacttgtacagaagaactgtccgcactcgtgctagagcttgaaccagcgtgcgtgcgaaccgccataaaccaaataaataacaaaatcaaaaccacaatggcagtgacgatgatcgttggtaaataattacgcacgcggctcgctggtgaagcaggttgttcgcgactagcaacccgggtaggttgaacttcatcaacattttcaacgatggtttcagtatgaacactcggtaattggtctcgatattcttctaacaacgcgttaccatctaaatcgacagtttccgcatattgcttaacaaacgcccgaacgtaaaaatcaccgggaagtttatcgaactgttcatcttcgattgcaatcaaatagcgtttctgaatcttggtgatttgttgcaaatcatcaattgtgaggtctttcgctgtccgggcagcctttaagcgcgccccaatcgttgttgtttcttcgttattttcactcattgactttttctccaccctaagtctattttcaaaatcttacggttaatagtatatcacagcaactaaatttagcagccccatgaccattaaatttcagatttccttaactctttgcttgtggtcgaatctggtattcactgattgcctgagaagtcaataattgttcagcaaccgtctgcaagtctgcaagggtcaactgatcaattatacccggttcatcaaagattgtcgccgtcccgaatagccgttgatcataccggttcgcgattgcctccaaggagttcgccatgaagacgacccgcccaatcatttccttcttgactaatgcgagtgctgcttcctgaccaactacagccgtccgccagttttctagcacatcaatgatggctgcatcaaactgggctggatcatccgtttcaccactaaaagtgacaaaattaaatccagactgtaattcgaaatcataaccaaacgtatcatcgatgataccctgatcatataatcgcaaataatctgctgacgtatcgccaaacaataattctaataaaacgttaaccgctgcacggtacttcaaagcagcagcccccgcttcaatcggcagcaagcctttgacaccaacgattgatttggcccgattgactggcatatcaatcgtccgataaggaataatgtcatgtccatccgttgcggtttcaggaatcttacgttcaatcggttgaaaggcagcaaattttttagttgcttgattagtcgtaatccaccctaacacttcgtctggatcaaaattaccaaccacaaataacgtcatgttctcaggatgatagaacgtccgataagcggcgtacaagtcatcagccgttatcttagcaatcgactcagtcgtccccgcaatatcatattgtagtgggtggttcggatatagattaccaatcattccgaaatacaggcgccaacttggatcatcatcgtacatctcaatctcttgcccaataatgcccttctccttgtcaactgtcgctggcgtaaaatacggatcttgaacaaaatctaagagggtcatgaggttgtcctgcaggtgccgggtagctgagaacaaatagctcgtcttcgtgaagctagtgaaggcgttcgcgctcgccccgtactgaccaaaaatttgaaacgcatcatggtcagccttctcaaacattttatgttccagaaagtgggcaattccatctggaaagcgttgcatttcagtacttccggctggaacaaaggtattgtcgatcgagccatagttcgttgtaaacgttgcgtacgttttgtgataaccggccttaggtaacaacgtcaccgtcagcccattatccaactgagcttgataacaactttcattaaattgatcatatttttttactttcatgcggttaccccactcaagaagaacccattattaagggtcaccatcttcgcgactgcaatgatctgttcacgcgtcacactttgaatctgccgtaaccattcagtatccgtaacgcgttgttgcgttaaatcatcgatcaaggcttgcacagcgaatgtccgttgactatccaaactggactcaaaatcgttgatcaagcccagcttaagctgttcaactaaatcatccgtaaaatcaccggcttgaatcgccgttaattgggccgcaataattgctaacacttggtcatgatttttgccatcaattccagcttgcaccttaagcaccccacggaaagtatccaatgagctgctggcatagtaagccagactcgccttctcacgtacattcataaacaatttagacagcggtgacccaccaaatagttcgttgaaaaccaaggccgcgtaataatgattgccacgataaaagactggtaaatcataacctaaatttagcttcgcttggctgagtgcctgttgttcactcacttcgacgtactggtttgtattatgatgttgataaaatggccgtgggcgccccgccagtcgatcctcaaaaccagcttgttgccactgagctaaaatggccgcctcatcaacgtcacccgtcacgataatatcgatttgatcattttggatcatcatttgataatagtcgtacaaaccttccgcagtgatggctgccaaatcactcgccgtaccgtaacttggcacttgttgcgcaggttcatccgcaaacaacgccgtatttaactgctgtgcggcataatattgcttatcatcagcgaccgacataatcgccgcttccaaattctttttttggcggtcaaacgtcacttgatcaaactgaccgtccgccactagcggttgtaaaacgacttgttgtaaaaactggatggcctgatttgtcagtggctgatccgttgccaaataccgttcatttgcaacggtgatggctaattgcaagttatgcgttggtcccttacgactaacacccgcaccaaacgcagcaccatacatggcagccaatgcgttggctaacgcccgctgatctggataatcacgagaacttgtttctaataaattcgataatagcgaccgctgagtaattgtttcacgtgcaagcggtgcccgaaaattgataataatctggttggttttaaattgatgactctgaaccgtcgtcaattggaccccttttgctaactgagtttgcaacatgtttcctccttgcatatgtaataaataataagcgaaaggccggattgacgcaactttccgtcctattgttttttttattttcagattatggtcgccaaaatgattattttcacgattaaattaaattctcgtgagtggcaattaacattgccaagtcgcgatttgtctgctattcttttcattattgataaaattaaggagcggttaatgtgaaagtaattaaatttggtggcagttcccttgctagtagtcagcaactgcaaaaagtcctcgcgatcgttgaggctgatcaaaaacgtaaatatgtgattgtatcggcacctggtaaacggttcgatggcgacaccaaagtcactgatttacttattcaatatgcccgtcaaacgatccatcatcaagatacgcaagccgttaccgcagctatcattgaccgttatgcagaaatcggtcacgggtttaacgttcccgaagcacaattgactccgatttttgaaacgattcgcaacttaccaaaacaatcatacgccgacaacacctacttgatggcagctttcaaagcgcacggcgaacgtctcaatgcgcaactggtcgccgctgtttttcaacaaagcggcctcaacgctcgctaccttgaccctaaagatgcgggaatggtcgttacggacgttcctgatgacgctcagattatcaagagtagttatgaccagctcgctaagtgggccaacagcgaacaaatcctagttatccccggatttttcgcctacaatcgtaacggccaaatttgtaccttttcacgcggcggctccgacattactggcgcgatcatcgctcggggtgtccatgctgaacgttatgaaaactttaccgatgtcgatgcaatttacgcggtcaatcctagtttggtcgcaaaaccagcggccattagtgaaatgacgtttactgagatgcgcgaactttcttacgctggcttttctgtctttcacgacgaagcgttgattccagcaatcgaaggcaacattaccgtcaacgtcaagaatacgaaccatcccgaggccccgggaactttgattcagtcaactcgcgaacccaatccccactacccggtgactgggattgccagttcttctagtttttgttcactatacttacgtaagtatctgctcaacaaagaagttgggctgggccgtaaaattctaacgattttagaaaatcatcatattagttatgaacacatgccatctgggatcgatgatttgaccatcatctttgatgaacatcagttgacgcccgaattagagaaaacgttagttgcagaaatctcagcggccatcaatcccgatgaaatttactttacgcacgactactcaatcttaatgctcgttggcgaaaacatgcgcaaccgcgtcggcatcatgtcacgtgccgccaccgcattagccaacgacaatattaaattaatcatggtcaatcaaggcgcctccgaaatttctattatgttcggtgtacacgacaatgatgccgatcaagccgttattgcgttatataaagaatttttcgattaacccatacgtccgactagtcaactagtcgggcattttttatggccgtgtttttcatcaattgttgttgaaaggtgccggcaattgaccccggatactcgttcgtcagcatgtacgtgtcctattccgatctccggggctgggtgacaattgctggaacgcagccgacgtcgatttgagctaatgcccaacccgcatcatctcaaatacgagtcttattctaagccgaaagcaccccactttcagctaagaataatttggctactgagcattgtcacccaacccctccagtctaaagtgtgcgagggatcacgggttgaatttaagcattgcctagtcaacggattaatgcggtttgggcatcagtccgttggcgtagcaagcacaggattcagcgtcaccgcgcgcgtttcgttaagccgctcgaatggctgattaacggccacttaacttggtgtaattggtcttttaataccggagcttcaaataaagcgtcaggtgtaaatctctatgtttatcgagaagttcaattattgctacattggttcagaaatagtgaaccataacaatatcattttctgtctgaccgttgcttgacaaagttatcgtttataaaaagtaatgacaagtccatcacaagttaggtacatcttcgtccgccattcgaatactgtcccgactggaaggcatttcggccaatgctcagcggtgaaattccacttagcaagcgttctttgcttggttagtggaagaccagtatttaagacgtggtcttcggcttaaatctgtgtccaccgcgttccagcaattggcagaaatgcctggaagtcggcttaggacgacgctagccaagcaagtttatgcaaaactcgaactttttccagcgggccttagctggttgtttttggccttatagcggcacctttcaacaatttttcgtgtataagtttaagccttcaatcccagtttgtctgcgtgccaatataaataggctttccaagacatcgtccgtcttggaaagcctatttatgattagttgctcaccgataactggggtcactgaatgacaagtcctgccacgtcacgctagttttcaactttttgattaccaaaccatttcttgttgatcttatctaacgttccgttagccttcaacgtctttaggccggcattaattttgcgtttcatcgttttgtcacccttacgcatcccaactgcgaagtcttccgacttaaaggtgccttgcgtttcttggtaatccgcagagttcgcttcgtgcttaatataatagctcgcgtagacgctatcaatcaagagccctttaattcgtccagcattcaagtcgaggaaggcattcgtgaaggtaccgtattgaactggcgttttcttagcaatcttatccttcagcagtttcggattgttttccaatgactcatagcccgaagaacctgactgcacacccaacgtcttaccagtcatatcgtcaaatgagttaatatgatttttctttaaagaaacgaggacttgcttgttcttcaaataagtattactgaaagccaccactttttcacgttggggatttttcgtgtagccgttccaaatcaaatcaattgtgccattgcgcaattcggtcgcattcatggaccagtcaatcgtttgaaagctgatcttaataccgtacaacttaaagacggcccgggcgaggtcgatatcataaccaactagtttcccagacttttcgcgaaagcccatcgggacaaaactgtcgtccaaaccaacgacaacgtaaccgcgtttcttgattttagaccaagtatcttgggtatcagcgcgtttagtcacattttgaccacagccacttaacgtcgttgccatacccaggagcatcacaacgatcaaactgagtgcaaataatcttttcttcattctgacgccccctattgcttcttggttggttcaacgtggaacatttcatccgcgatattttcagcaaaggttaaatcatgggtcaccacaatttgagtcatgccatcagcctttaagcctaaaatcaacttttcaacttcctgtcgtaagttcgggtcaagtgctgaagttggttcatcatagcataagacattcggtttcatggctaatgcccgggcaatcgccactcgttgcttttgaccacctgataattcgaaaggatactggtcagcgtgatcaccgagattcaaacgatctaataatgtctgcgcctgctgttctgcttctgcgctagactgctttaagaccgtggtcggtgctaaagtaatattctgcatgactgttaaattgggaaacaattcaaaattttggaatacgacaccaattacactatcgttactccgattagtatagggatcaaatggttggccgtcgactaagaactcaccggcattcaccttttcaagccccgtaatacagcgtaataacgttgtcttaccagcacctgaagggcccacaatacttagaatctcgccatccttaacggttaaattcaaattcttaataattgtccgtgaaccaaagctttttgtaatattttttagttctaacatatgatggcctccctatttccagtaactgtaatgtttttcgattcgtccaagcacaaaagtcgttacggctgtcagtgctaagtaaatgattccgactaatactaagggtaccaaagtaacatcgcgcgctgtcgcaacgttaccggcacgtaacaagtcgccgagaccaatgacataaactaacgatgaatccttgaccaagttgatgacttcattgccaactgacggtaaaacaattttgatcacttggggaataacgattttacgaatcgtctgccagtagctcagccgcaagacccgtgcactttcatattgaccattgtcaatcgactgtaacccaccacggaagatttccgcgaagtaggccgcgtagttcagaataaatgcgaataacgcggcgtagtaccgtggaaaaacaatcccaatcaacggtaagccgtaaaagacaaagattaattgcagtaacaacggggtaccacgcattaaccaaacgtagaaatgcaataaccattgcagcggcttgaagttagacattaatcccagaccaacaactaaccccaatggtagcgacccaatcaaggtccaaatgaaaattttcagtgtcataacggcaccggataataatgatggcaaaatttctaaaatatactgcatgtactttccctcccaaatttacaggtcacattgtcctgcgtccactaatcggtcacgactcaagtacacaaaaaagtccccttgagtcgaatactcaagaggacggttatccgtggtgccacctcacttcgtaataacttcacagttattacctcagggagttttgtgataataaaaaaatcgtccttaggccagcatgcctaagaggacgatttaatcgcggttccacctcatattcactagttgctcacacaactaatctcaacgagtttatcactaaactccgccgctaacgaggccaaccgaaacagcttactaacttcagctgtccaactcacagatgtggttcgttgtaatccttggtcatcttcccatcatcgataactcgctcggcaaggtccttacaactactcttctgttccctgttttttaatgttgagttcatactaatcgaaaattaatcaaccgtcaagccttttttacttgccacgatgaaaaattccggcgattcgtgaccaaacacccggtttaggtgtatccaaattcattaatggcactgtttcaccttcgattcggcgggcaatgttgcggtagccttgtgaggctggattcttaggatcaagaacgatcggttcaccgttatttgaagtccgaatgacggcatcgtcatcgaaaacgattcctagcaagtcgatcgataagtgatgcgtaatttcatcaatatccatcgtctcaccatcttgcatcatgcgcgtccggattcgattaatcactaacttaggtgcttcggctaacggatattgttccaataagccaacgacccgatccgcatcacgaattgctgaaatctcgggtgtcgagacgataatagccgcatccgcaccagcaatcgcattcatgaaaccttgttcaattccggcgggacagtcgagcaaaacgtaatcaaaatctggtttcaactcgtctacgattgcccggacttggtcaggattcaatgcatccttgtccgcattttgtgcagctggcaataaaaacaataagtcatcaaaccgcttgtctttgaccaacgcctgccgtatttgagcacgaccggcaactacatctacaatatcataaaggatccggttatcgagacctaaaataacgtctaaattccgcaatccaatatctaaatcaactaagcaaactttcttgcccatcaaagcaagggccgtccctaaattggccgtagtggtcgttttgccgaccccacccttaccagaggtgatgacaattgcttttcccatcaaacacgtcctccatttcgagtaaatagcttcggtcgtacccgttttaattgctggagcggctggtagtccaacgcttgaatgtcattaatatagacgacgttcgtcccatcaacaactttttcaaggtccactaattctaacaattcaccgactcgaacccgcgggacggtcgctaaggggctaacgatcaccgcatcattgtgatcgggataaccggcctcaagcgcaccgtttacctcacccatcacaaagatactacccgtcgcccggatcaccccaccttcatggatcttaccgaagaacaacacgtcccccgtaatctcaacgacctgaccgttgcgaataatctgattaaccagatgcaccgtatcacgttcaatcatcgctaaagcatccgccgtcaaaataacatctgccgttagcttatgaatactgaataacggatatcgttgaatcaactgtgtcactttttgattttgttccgcagtcagtagtcgactagccgtatccaggtcaaacgagatttgtttatcagtcgtattatcagcctgcaaccgatccaacaagaccttcaagtcgaccataatatcatcgaaacttgcttcttgccgtaaaatcagttcatagccgtcattactggcctttaaaactacactctgttgcatgttagaattcctttctgccgactaattaacactcagatataaccgacgcattggataatataatatgacaaagatggctaggttgaccgcaatcgtcggtcctagcgtgtacaccgcaaagtctgctaacccactagagatcacatggctcatcgtgtaccaaatatacgtaaatgcttccaaaatggtcaaattaataatatagatcatcagtaacgttaaaaagttcaggtcgatccatggcttgatttgtcgacatatatagactaccaacggtaagccaatcatgtaaacgcctaaaatcccagtatagtaccagtcaaacaccaagcccacgaatgcagaccagattccaaccgacagattatcacggtcgtctaaaaagacagcgaagacaatccacagtaaaactaggtgtaagacactggcgtacgggtaactaaatagtttaccggcaaaaacatttgacaccgagccgtctaaaaagagtgcaacaaataacccaattggaaagacgatttttaatcttgagtaacgcaccgttgcacctccctattgttcagcgaccgtcacaactgttaagtcactaagatccgctgcgggtgtgatttccacttcggatgctagtccgtaatcatcctgcttgacactagcaaccgtgccgacataaagtcccttcggcgtattgccgcctaaaccactcgtcacgactttatcgccttttttgattttaacgttagacgtcacggaacccatctctaaaagattattgctcttatcataacctgaaataatcccgttaacagtcttaccagcactattcgtaatctgaatagcaaacttattcgaagacgaactcgtattagaaattaattcaaccttagaattcgtttggttaacttccacgacccggccaattaaacccttttgtgacatgacaggcatattcttctttacaccggatgtcgcacccttagagatcacgagttggttcatccaagatgatggtgtccgcgtcaaaacattggcggtcaccgtcgtataatcagataacgaattatttaatttcaactgcttgcgtaactgcttgttttccgcacgcgtcgtctgggcactaaccttggcctgcgccagttggtcaacttgcttcttcaatttttgattttcttgataggtgttcaacaagtcagaaactgagttggtcgcactttgtaagccattgactggccaagcaatcacccggtcaaccgcaccagccacatcgtttccgaattgttggatcaatggtggtgtcgatttcttatcacgaatggctactgagacactcatcaagccgaaactaataatgaacacgacaatcgcaatcactagttttcggttagaaaaaaacttttgcataatgaacccccggtcgaaaattcaatgatttaacaataaataagcgggaagacgtcttcccgctcacctgttatcgctttttcataacgtcgatgctcttgagtgattcaccggtcccaactgcaacacagtcaagcggttcgttagcgatgaaaaccggtactttggtttcgtccgcaatcacttcggaaagattcttcaataaggcaccaccaccggtcaaaacaatcccgtggtcaattacgtcagaggcaatttctggggaagtttcttcaagggtttctttaatggctgaaataatttcagagaccacttcttggatggcttctgaaacatctacagatgagatttcaaccgtctttggtaagcccgacaaaagatctcgtccacgaatcgttgacccttccaagtcttcagcggcttccaaagaagctgagccacagtcgattttaagttgttcggctgtgcgttcaccaattaaaagattaaacttctggcgaacatggtaaatgattgagtcatcgatcttatcgccagccattcgaattgaacgacttgatacgatcccacctaaggaaattgtcgcaacatcggtagtcccaccaccaatatcaacgaccatgctcccagttggatccatgactggcagccctgcaccaatcgcggctgcaaatggttcttcaatgacatatgcatcccgcgcacctgcaacccgtgttgcatcaataacggcccgtttttcaacttcggtaaccccacttggtacacaaaccatgacgtatggcttaccatttgagcggccgagtgtcttttgaataaagtacttcatcatcgcaacggtcgtatcgtagtccgcaataacgccatccttcattggccgaatcgccacaatgcttgctggggttctcccaatcatatcccgtgcttctgaaccaactgatacaatttcaccagttttcgtgtttttcgcaactacggatggttcacgtaatacgatgcccttgccgtcaacgtacacaattgtgttggccgtaccgagatcgatcccgatattctttgtcccaaatccgaacactacattcatcccttcatcattaacaaatttaattttttatttagtcataatagtaagtattatagcatagtcgcactgcattaaaaaagcattgcctgaatcctagcataccgtaaattaatgaaaaatacagtcccactatttaacttagataaaatttaacaaaaaaacgcgatcaggccgattaaattatcggtcctaaccccgttattttaccacattctgttacgaatccgtattacaatttaacacgccctgctcggcaaaactgaagtaatcgtttacaccgataataaagctatccaagagcggtaaccccatcagttcacaagccagttgtaaccgcttggtaaattcaacgtctttttttgacggcgtcacatcaccactcggatgattatgtgcaataacgacccgggcagtcggtgtcgttagggcaactttaataatttcccgcggttgagccggacagctattgagcgtgccctgaaagacgacctggcgtttgatcacttgattcttcgtatctaagcataacaattgcaactgttcctgctctaagttggcaaagtcccgtgctaaaacggctcccagttgttcactaccatatacctgccccaaaattaatcgacttggccggggtaatagttgcccacatctgagcgccacgattaaaccttgccagcgcggattttcagacgactcatgtaaccactctatagcgtcctctatcgggtactcacgctcaaaggcctgcatcgcgctagtcaccgcgtcgttgggtaaaaacgtcccaaagtaggcttgcattaattcacgaacttgtgctatcggtatttgttcttcgctgatcatcgtcattgaaaccaccctttctacctagtagtttcgtaaagtgaccggctaaccattaattcaccgacattttaacgcaattttttcagttaactcacaatcatctttgataatatcagtaccagggacgcagtattatttcttgcgcaattgtcttctaagcatccgtgtcagtccctaatcagtttctgagtcgctgccattcttgaaataagcccgtacgtcactaataaagtacagcgaccccgttagtagtaacgcatcatcactcgacatttcttggagtgtctgcatcaaggcagcttgccaattatcaaatacttcagcggtccggccatttggcatttcatgtgccaacatcgtcgggtcggtcgctggacgttttgcgttcggaccttcgaattgtgtcaaccgtaattgaacattaggtaatgcgcccaaggtctgaatcatttgttgatgctgcttatccgctaagaccgcaaagatgacataaacggtttgctgtccaaatcgctcactcaaagtagctgctaattcagttactgccggctcattgtgcgcaccgtcaatcatgatcagtgggtcctgattcaagcgttcgaaacggccaggccattgtgttgctgccacagccgctttgacgtcgctagtgaccacgggtagctgagtcgcttggtggtaagttaggtacgccgctattgcaacggccgcattatcaacttgatagtctcccagtagcggagttgtcaagtctttaaaatgcgcctctaacccgtcaaagttaaaccgttcttgccagccttggggcggtaataatttggttgtaaaatcaactcccaacgtccgcaacggcgcccgtttgctcatggcggtatcaatcatcacttgctgtgcttcagccggtaatttaccaacaattaccggcacctgcgtcttaatgatacctgctttttgagtcgcaatcgccgtcaatgtattacctagaatttgcatatgatcataaccgatcgtagtaatcacactaacggctggtgtccaaacattggtagaatcgtataacccacccaacccaacttcaataatggcaatatcgattggctgagcagcaaagtaaagaaacatcattgcggtaatgatctcaaattctgtggggcccccacttgccaatgtcgcgtcaagcttggcaacgatcggttgaatctgttgcaccagaccaacaagttcttcatcgctgatgggggtgccgtcaacactgatccgttcattgaagcgaacaatgaacggcgacgtgaaagttcccaccgttagcccatctgccataaataattcgcgtaaattcgcaaccgtcgaccccttgccattggtccccgccacgtgaatgccggccacctttaactgtggatcacccaattcatgtaagaattggcgcatacgactgagtgtcggggcttttttgaactgagtccggccgtgaataaaggctaatgctgctgaataagtgtcaatcatgttggtcttccttcctgtaaaccgcgcgaatcatcatttggccgtttgctcaccatacttctagctaatgagcccttatattttacgttttaataataaaatggtaaccatcccaaaacgggacgattaccattttaccagtaacacacatttcagttaactattatcgcaaattaagcttcagccttaatatcaactaaacgttgctttaaggcagctagttttgtctgattgtccgctaacttctctttttcactattaacgacgtcttcaggggcattggcaacaaagcgttcgttacctaacttcttcgtcgcccgtgcgacttcgctttcaaacttggcttgttctttttcaagttttttgacttcttcatcgaggtcaacaagttcagctaacggaatgtaaacttccgcatcactaatcacttgtgtcatggctaacttcggtgcaaccacgtcggcgccaattgacagtgtcttcggatgtgcaaaccgttgaatataatcttcattagctttgaaaacagcttgtaaccgagtgttgtccgtcttaattaatagatccacggctgatgacatcttcgcattagcttctgctcgaatgctccgaacggccgtaatcaattcaataagtgaggccatatcactttccgccgtttcgtcatcaaattcaggatggtcaacaggataagcagcgactactaaggattcaccaacgtgtggcattgataaccaaatcttttcggtcacaaatggcatgattgggtgcaataaccgtaagatttgatccaagacataggctaacacgttttgggtattggccttggcttgagcgtcatcaccggtcaaaacttccttactcatttcgatataccagtcacagaagtcattccagataaagttgtacaaggctcgaccagcttcaccaaagtcaaacttatcaaaggtagtcgtcacttgtttgaccgtcgcgttcaaacgattcaagatccacttatctgctaacgtccagtcacttgcagctggtaattccggtttgtccatggtgcccaggttcatgataacgtaacggctggcgttccaaatcttgttaataaagttccatgcagcatccatcttcgtatagctgaaccgcacatcttggccagccgtcgacccgttagataagaaccaccgtaatgcatcggccccgtacttttcaatcacatccattggatcgatcccgttaccgagtgatttgctcattttgcgaccctgttcatcacgaattaaaccgtgtaaaagcacgtgtttgaatggccgtttgccagtaaattctaaactctggaacatcatccgtgatacccagaagaagataatgtcgtagccggtaaccagcgtatccgttgggaagtagcgcttaaagtcttccgcatcagtgtttggccagcccatcgttgaaaatggccaaagtgcacttgagaaccaagtgtccaacacgtctggatcctgttcccagttttctggatcttttggtccatcaacaccgacatacgtttcgccggtcgtcttgttataccaagctggaatccgatgtccccaccagagttggcgtgagataacccaatcgtggacgttctccatccattgattgaatgtgtcttcaaaccgatcaggcacaaattctactttattatcagtcttttgattcttcaacgcttgctcagctagtggcttcatcttaacaaaccactgagttgagagccgcgcttcaacctgaacgccagtccgttcagaatgcccaacgctatgcacaattgggtcgattttaatcatcaaatcttgatcttcaagatccttgaccatcgctttacgtgcttcaaaacggtccataccttcgtatttacccgcattggcgttcattgaagcgtcatcattcatggtgttaatccgtttcaaatcatgccggttgccgaccttaaagtcattcgggtcatgagcaggcgtgattttcaccattccagttccaaactcagggtcaacatacgcatcggcgataattggaatttcacgttctgctaatggcaagatgacttttttgccaaccaattccttgtaacggtcatcactcggattaaccgcaacggcggtatcgcccatcatggtttcaggacgagtcgtggcaatttcaatgtaatgtttaccattgaaagtatagtctttgtcagcaaatgggtacttgacgtggtagaacgcacccttgtcatccttatgaatcacttcgatatcagacaaagccgtccgtgcttgaggatcccagttgatgatgtattcaccacgataaatcaagcccttgttgtaaagatcaacgaagactttcttaaccgcatctgacaggccatcatccatggtgaaccgttcacgagaatagtccaatgacaatcccatcttagcccactgttgtttgataatcgacgcgtattcgtctttccaatcccaaacttgttgaataaacttctcacgaccaagatcgtaacggctgatcccttgttcgcgcagtttggcctcaacctttgcctgtgtggcaatgccggcatgatccattcctggtaaccataaagtatcaaaaccttgcattcgtttctgacgaataataatatcttgtaacgtggtatcccaagcgtggcctaaatgcaacttacccgtgacatttggcggtggaatcacgattgaatagggtttagctttcttgtcgcccgaaggcttaaataaatcttggtctaaccaagtctgataacgacccgcttccacggcggtcggatcatacttagttggcatatcagtagttggttcttctgacattggggcacatcctttcttttggcactaaaaaagtccactcatcctattagactaggacgaatggacttcgcggtaccacctaattttaaagccatcacaagtgatcgctttacagcttaaacatcgttgttaacgaacggtgtatcccgtccggctattcctactaaaacagttcagaatagcagctcgcaagctaccttcacgctaaaaccgccaagcgtgtttcactgttcacgctctctctgttgacgttgtttatcgctactctcttgctcattgctggttgtcactattgtaatgaatttcctgagtgccgtcaatccttattcgaattgttttaaggcatccagtgccgcaacgtaatttggctcgtgactaacatctggcacgatttcatgataaacgattttgccggccgcatcagcgacataaatcgcccgggtcaacgtcccattgttgggcaagtatagattggtggcgtaaccaaaggatagttcttcatcggaagccaccgttaagttcttaacgccttccttagcgcaccaaccagcttggtcagcaaccgcgttattggaaatggctaaaaattgaacgtgggggtacttatcagcctgttgattgaacttctttgtttgaatagaacaaactcgcgtatcaatatctggcatcacacttaacaagacaggcttacctagcaagtccttagtcttaatcttttcatcatgggtagtgaacactttgaacttcggtaactggtcaccatcttgtaacggttcaccgactaagtctaacgcttgatcatgaaataatacttgcacgtaaaacaccccttcgataactaatggttttctaatatttgtggtagtaatagtatagctcaaatttaacgcaatttcagtttccgcgcaaataatcgtctcaaaaattatcattcttgacatgcgacgcgttatttgacgttagtcatggtttaaacgtgcttattagttggtttgctgttcgtcagccgatgcgcatcctaacgtgccaacatgtgtgtacgccgatttcagtatattcaagcattaaaatgtggtgtcgtagccagctggagtgcaagttgggttgcacgttcgagcgaatcgtttgtttgttgttcccagcgggcagcgagtgtgttggccgggtcgtgcagactagttaaaatatgttgggcgacttgcaacgcgtgtggttgatgtaaactggtagccatagtttgtagcgcgtcagctagttgttcgccttcagttagctgtcgagtcacttgcatgggggtttcgatggcaacttgttcgttggcgcgctgacccgcctgaatccaattatccgtactagctggcactggtaaccagagcatcagtaaaacgaaccacgttaagcaggtcagttgggacagatcgatgcccgcaccggcccatgggttcagatctaagttacgtaattccaagtattgaatcccatcctgacatagttgtgaatgaccaccagcatgacgcaaccgaacctgaccgtaaaattccttggtcgcacttaattttccattatcaacggccgcttgcagtgtttgacaatagtcatttaacgacgcgtacgagaccgtaacacccggccgattggtatacccgctagaactgttgcgtaagcttcgaacgggctgggctggtggcgtaagaccagactgtggccagcagcgtggtgagcagccataaagatacgtcagtagccagcgatagtgcaaataattctgcgcaatgtgcaggtaacagcgattttgaaaggtggtgaaatcacgactatctgtctgggcctgatacaatcccatcatcagactagccgccaagctcacattacagtgaacacctgacaacatttgacgtcgtcggccatagcggtgagcaagtccttgtcgataggcgacagcggccgcatccaacttagcaattggaatatcccggtcttctcgtggaagtgtgggcggcatgcttagcggccaaatcagttcaggcagaagcctttgccggacttgttgtgtgagcatcgttaaggcgtgcaacgcagcaaccgcacttgcttgcggttgggtgactaactccagctgtgtctccgcaaagtcccgttgcaggccggacaactcgctgataagtgttggtgataatgccgtatccgccaaatgaccggtcaccgttacccgctggccttcccgttccagcccaatctgaacaacctgtgcattgatcaacgccgtattttccattaataattgttgccactccatccactcacctcgctgattcaatctaaatttatcgtagcatagtcacgaccttggttcgctgattatgacctattatttagctgacttaccattacgaaatgagcttccgcgcgtccctgcttgatcatccaaaagatcaaaaaaacgagtacccagtattaccgggtactcgtttttagggtaataatatcacccgtttttgacctacaatagttcagcaaaaacgtcttcttgtgtattcaaataattttcacccggcttgatctcagtcattttaacaccagccaaagcgcgtgccatcagtccttcaacatcaatccgttcttcgtaggaccgtgaacggtctagcttcggatgcgtcttgggtgctggcggcgcaaaaatcgtacaacaatcttcaaatggcatgatcgacaagtcataggtatcgatatcttcggcaatcttaatgatttccgtcttgtccatggaaatcactgggcgcaaaaccggcaaggtagtcacatcattgatggcaatcatgctgtccatcgtttgtgaagccacttgccctaatgattcaccattaaaaatcgccttaccatgccgttgacgcgtaatggcgtccatcaaacgcatcattaggcgccgttgaacggtcataagataaccttcgggcactttttctttgatttcttcttgaatctcagtgaatggaatttgaataaacttcacgctaccagagtaacttgctagcgttgacgctaactgcttggcctttgctaacgcctgttcactcgtgtatggcggactgaagaaatggaccatttccatgtccacaccacgcttcatgccaaggtagccggcaactggtgaatcaatcccaccagaaagcattagcattcccttgccagcggtgccgaccggtaatcccccggcaccctgaatcgtttctgatgataagaagataccgtttaaccgaacttcaacacgtaacacaatgtccggattcttcatcttaacttgaatcccgtcaacgtggtccaagatttgcccaccgagcatgtcattgatttgatttgtatcgtattcaaactgatgatcggagcgccgtgtgtaaattttaaaagtcatccccggtttaaactgggctttgaccatcgcaatcgccgtttcatagacggcagccatgtcggcatcgacgcgaatacttggtgaaaagttttgaattccaaaaactagcttcaaacggcccatgactttatcggcatcctcaccatttaacatgatgtgcatccggtcacggttcgcgtggacctttagttctggaaagtcgtgcaacgctttgcgtacgttacggcctaagctatcgataaagttccgccggtttttacccttggtcgatagttcaccataacgtaccatgatttcagtgtactgcatgaacaagttcctttccgttatgcgtctgcattaatttttgagaatttttgataaagttgatcaaatactttaataaactggtcagcttctgccagcgtattattctcatcgaggctgacccgcacagcactcgtcgcaatgttttcttgcacgtgcatcgccattaaagtactggaggccaagtgtttcttcgatgagcaggcactcgttgttgagatataaatgccctgatcttcaaacgcgtgaacaatggtctcgccccgcacaccgttgatcgtaaaacacagtatgtggggtgcgaaccccgtcgttggctgactgaaaatcgtcactttaggaaatgacttaatgtgctcgtagattcgctgtttgatagctcgctcacgagctaccttaccatcttcatccgtgagcaacaatcgcagggccttcgccatgccggcaattgctggtaagttctcagttccagaacgccagttactttcctgaccgccgccattcattaatggcgctaacttacgaccattgcgcgcgtaaataaagccaacccctcgagtcgcatgaaacttgtgccctgaaaaggtcacaaaatccacccggtcattcatgatcatgttctggattcctttaccaattccttggactgcatcaatatgaaaatgaattttcggatattgtttcagtagttccgccacttcaagtaaaggctgaatcgtaccgatttcattattgactgccatcgttgacactaaaaccgtgtcaggccgaattgccgctttcaagtccgccacgttgatacggccttcctgatcgaccggtaagtaagtcacttcataaccaagttccttcaattgttccatcgaattatgaatggcaggatgttccaccgccgtggtaattagatgcttcccaaaggcccgcttttcaatcgctgtacccttcaaaacccaattatcgccttccgtcccaccagacgtgaagaaaatttcgtgggcttgcacacctagtaagccggcaatttgttgacgtgattgttccaacaaatgaaaggccgtttcaccaaagttatgcaaactagacggattaccccaaattttttgggaaaccgttgtatacgtctccagtacggcaggagcagcttgcgttgtcgcactattgtcaaaataaatcattactacgccttctctttccaagaaagtgtgcattgcacttactttcgataagaattctttgcaattataccaaatattactagtgaaacaagggtttttgtttcaaattcctgattaatcacacgacaattgcgtcctaaacaccatttttgttggccgttcgcagtcacccttcttagatccatcacgaccacttgcatcatgatgccaactaaaaaccagctggtggcggttgtcatttaacaatcaccaccagctggttattttcagctaactaaaattgtgcatacggacggtcccaactatcctcgtcaggcctcatcgttcatcttgtcagcttgtttattcgcatagtaactgtcctcaatccgtttataggaccccggatcaaccttatccacagctgttgcaattacttctaaactccgcgcgtagtcatgagtctcggtaaacaaccgttgtgcttccacgctggcttcttgcacctcttcatgattcgtcttgtaacggttagcgtattgtaagagctgttccgccataacagcagcatccgttaaatcactggtcttttcctttaaggtcgccatatccgcttgaatgacaatcaactgtttcgtgatgtcgtccatattgatcacaagcttattaatatcatggtcaagccgttcgatttccttggcaactactttgaaatagtccaaatagtctttcggtagtccaggcaagttcaaattttcaacctggcgtttgatcgcgtggatttcaaaatcgaaccgttgcaacgtctcgtgggctttggactcttcagcggtcaaactcgccacacctttgttaattgccacttgttcttcttcaatgcctttcaactgctcatcttgttcggcaaaatgagctgcgatctcactaaagacagcttgcttactagtaatagctgtgacgtccgcctgataaacagcttcgatattcttcagttgttcgttcaattcacgcgtccgttcaacttcgccattattcaacgtatagctttgtgctaatcgatccaactcaatttgtaagtggtgattctgattcatggcatgtgtcaagaacttactgatttcttcttgttgttgatcaacaacggccttagcatcgatctctgcttgcatcacgtcgtataagtggtcgatccgcttttcaatcgcatgattgccgttttcagcatccgtaactttcaaatcaccaagtaacgcaatattatcgtcgattgcttgctgtaacgctttgatttctggttcaatcgattcgacctcaaagtgaaaatgttgagccgttaattgttgataaccactagccagttcggctaactgatcaggaaacccactcactaggtccttataaatcggtggaatccgatcaatatccatttcaagagtgccagtatcgtgatgtaactgatccaaaaccttttcagccgcgtcatgatcgccagccttggctaattcggaaaaatgatcaaaatcactttctaagttagctaactgatcctccaatttgtcgatgctcggaccaaatgaaaagttttgcgataataacgtcttccgtatgttttggtacttcttctctaaactagccactgcttggcggtgcgcggcatccgcgtcatctaaggcctgcaagccctgacgaatttctgcctgtcgttgttcaatcgtatttaatgtggccgcaaccttcttcagattctgctgagcatcgagaaatctgatgccccgcgcctgcgaagtaatggccgttaattgctcactaacggcgggtaactgatcattatcaacttcttgaccagcgctctgcaacgcttccaacttcgctaacgatccgcccgttagtccgagttgttcaattttttcgaaatctgtggtctgcgattgcttgactagcgcctgttgccgttccgtcaattgacggacttgcttgtcgatataaaattgaaagcctttgaccgccgcgtagatgacaatcgcaaccacaacaatgccgattgctacttgcatacgaataccccttacattatttattccgttttaattgcgttgcgcctcaccctgttgagaaccgtaaccttgcttttttctgaaaatccaattaaaatctatcttaaattataacatagacgtaactaacggacagtaacaatttgttaacattcaaggaggattttttgcatggctaccacggaaacatcacttatgaaccaacaactcgacgccctattgtttcaagaaactaacctggtcgcgaacttagctaatgctagtgccctcctcaacagtacttatgacaaccttaactgggccggcttttacttatttaacgaacaaactggcgagctcgacttaggtcccttccaaggcaaagtcgcttgcatgcacatcaaagttggggctggtgtcgtcggaactgcttttgaaacgcaaacgaaccaacgggtagccgatgtccatcaattccccggccacatcgcttgtgacagtgccagcaactctgagatcgtggtcccaatcaccaaggacggccaccaaatcggcgtactcgatgtcgactctccatcattagaccgattcaatgctgataacgaagctgaattgactgagtttgtggcaattctaacgtcacacattgactaatcagcattaaacgtgttatgctactctttgtgtaaaataatgcagcagtgagtgggtaagctcgtcaacagattggtgccaatattttggtcagttagtaacctgcggctgcaatggtgaaacctgcagtccaatctgaacgaatatcgaacttacatcggattattttactccaactaaaattattggaggaaacattttatgtctcgttatacaggtccaagttggaaaatttcccgtcgtttgggaatgtccctttcaggtactggtaaagaattagctcgtcgtccttacgcacctggtgatcatggccaaggtcgtcgcggtaagctttctgaatacggtacacaattacgtgaaaagcaaaagttacggatgatgtacggtttaactgaacgtcaattcgctaacttattcatcaaagctggtaagattcgcgaaggtaagcatggtgttaacttcatgattttactcgaacgtcgtttggataacatggtttaccgtttaggcttagcaacaactcgtcgccaagctcgtcaattagtaaaccatggtcacatcactgttgatggcaagcgtgttgacatcccttcatacgaagttagtgtcggccaagttgtctcagttcgtgaaaagtccaagaagttggctgttatcactggtgctgttgaagcagttgttgcacgccctaacttcgttcaattcgatgctgataagcttgaaggctcattaactcgtttaccagaacgtgaagaacttgaagcagatatcgacgaatcattaatcgttgaatactacaacaaactttaatttccggtatttaaaaaccgtcgcgtttgcggcggtttttttgtatgttctgttaatttcagacctgacgctcagcactcacagccgccatgaccggttgataaatcgacaataattgtttgaatgttgtgatgatcaatttattcaacgtatcagcatcttcaaataacggatcaccgaccaagactgcgcggcccacgaccaactcgctgtgtttatactgatcgaatttcttgatggcctgcgtaatattggccggtgttgcaagttgcgtggccggcaccccatgattattactgataacatagcccgccggcaaggccttcaaaagtggtgttaaatctgcgagttgcatctttgcctgcacggccggtttacactcatccaaaatatcaaaatagataaacaaacggtcaggccatagccccaattcaaaatgtggccaggctttgtagctccgtttgttttgactaaaagcgacccaagtgtctaccggtggattcttaaatcgccgtaaatgtttggcaacgtgcgcgtagaacggtggctcgctaggtgtttgtaaactcgctataatcgttggtgcgacctgttcgaacttaggatcgatcaccgttttgattaaatgcatgcggcccgctaacgtctggtcattaaaaatttcaaaatcttgatttgtaaacaagttttatcatccccaaaactaatttagattaaccataccgcattcactaacgcaacgctaccccccttcccttcgctattattggaggaacatgctacaatgataattactatcaaggaaaggatgttagacaatggctgaaacagataaacaaccagttgaccgcatcgaaacggccatgcacgggacgccaaagttgcatcccgacgaacaacgcaagtacctggggacctttcgggaacgcgtcgaagtcgcagtgaccgttgcccaaattaaacaggccaattacgtcgacgcacttaatcaagcatttacgagccatccggatgaccaattatatattaatggtaatttagaccaggaactgattgggccgtatatcaaggcggctagtcaagccaatatcaaattcactatcaaaacggatgacatctaccatactgctgatgatgattacgcgcttgtcttcactgctgcaagcgccattaaccaagatattattgatgttgcgcagcgttatccctcgcagacttcatcagcaacaccccaggccgagaaaacacctgggctgctagataaattcaaaaagttactttaatacaacaaaggtccccatccacgcacggatgaggacctttttacgtttgactgcgttaattacgcgctagagtgccataaagactcatgataactaaggccgcaacaatgatccccatgaggctgactgaaacccatgctgttgtgacgatactcagtagtaacaatatcccaccaccaactagcgtatagcccaaccaataacgaacacgccgccaaatcattggccgaatcgtgtgaccacctcggtgcatctgcacgtattgatttgcactgattgttggcaaataattcccgatggccatgaaaataaaggcaatcaaactaacggcaatacgccaaatatccaattgatggcctaagttataactgatagttgtcgcatagatcacacttgatagtacaggcacgatccaaatgatcatctgttcaaaccgtggcgccggtgccttatgattggcattcaaccgtgtcaccccaacgcaaatcagctgaaacgccatcatcataattggaaagccaacgaccactaataattttgcggccattccattaggttgattatccaaattaaaatgaatagccattttggcgggcaaggccgcataattcacgacgccgtagctcattggtaacagaataacaatatagctcagccacaactgcaagttcctttttgtcatcacttttcatccccctgctttggcctaaaacgatatagccacgtcaacatttcctcaaatacgctcgcatttagctcatagtacacataatttttttccttggtcacggtaactaaaccagcttgcttcaaaagcttgagatgataagacaccgttgcattacttaacttgaaatgagccgcaatctcaccagccgattgccgattctggcgtaaatcttccaaaatctggcgtctgacaggatctgcaattgctttaaaggtcgtattcaacgccatacgggctacctccaatcacctatttagatatatatctaaatagagtataacaggcaaccaggaattcaacaagagatatttagataaaattcgaaataggtgttttcaatcacgacaccgtgtattgactataatcctttatataaaataaaaggctaacactggacaactcgattgttgcactgttagcctctgttaaatttaatcaatactgaacaaataagcaacagcaccatatgctggtaaaacaacactgttagtctcttctgcaatgttttgatcattactaatgatcttctcacatggtctattctgcagttctgttggcaaaacaatttttttgggtttttcggtaaaattcccggcgactaatagtatctgcttctgatctcgtcttaagtatgaaaatacttgttcattgtcgggatcaagcaactcaaagtcacccgttgtcacaatcgataaagaatgacgcaacttgatcagttgctgataataatagaaaattgagtctttatcctttaacgcttgttccacattaattctagtatagttaggattgacgctaagccatggcgttcccgttgtaaaaccggcattatgtttgctggtccactgcatcggggtccgcgcattatcccgtgacttcaaataaatggccttcattgtgtactctttgctgagatgtttatgattaataaagtcttgatagatattatgtgtttcaatatcttgatagtcatcaattgaggtgaacttggcatttgtcattcctagttcttcaccttgataaataaacggtgttccttgttgaaaatgtaacacagtcgccaacagcttcgcagatttaactcggtactcagtatcatcgacaccaaaccgagttaccggacgtgcttgatcatgattgctccaatacaagctattccagccatgatgttcagccatgcctaattgccacttattaaacacttgttttagtgcggataatttgaagcgtctcgtagaaaacttaccattttcatcataatctaaatgcatatggtcaaagtggaaaaccatgtttaattctttacgtcgttcatccgtatatttttcagcctcagcaacactagtatggggtgtctcgccaacagtcataatgtcataatgacttaatacttgctgattcatctcacgtaaataatcatggattttaggcccattggctgcaccataataataactgccatacgctttattttgaatgaccggaccatccggataagtcggttttttcgacaacagactgatgacatccatccgaaaaccatcaacgcctttgttcaaccaaaaacgcataatttcatatacatcctgacgtactttagggttttcccaatttaaatcaggctgttgctttgcaaacaaatgtaaatagtattgaccgagttgatcaacatattcccaagctgagccgccaaatgaggaaccccagttgttaggcaactgttctttactcccatctttccaaatgtaataatcatgatattgattgcttgtactttgcttagccgccttgaaccacggatgttcacttgatgtgtgattgacgactaaatccaaaattaatcgcatatgtcgctgatgtactgcatctagtaatgcagtgaagtccgctaacgttccgaactgatggtcaatttctcggtaattgctaatatcataaccattatcaacttgtggagattgatagataggattcagccaaataacgtccacaccaagttgcttcaaataatctaacttttcaatgatacctcttatatcgccaattccatcgccattactgtcattaaagcttttcggatagatttgataaacaacactcttccgccaccactctgttttattcatcatcatcatccatttctatactcatttgattaactgaaacaattgattcttgagcctgggtgattaaatcgcaaacccgatgatctgttaactcgtgatcagtcggttctagtgcaatggccaacgctaacggaagattcatgccactaataatttgtgtgtgggggcgcattcgataattaaaaaattgctgatttacactgcccgccagcatatctgtcaaaataacgatctccacttctgcaggaatactagccattaatgatttaacttgttgttctactggctggttatccatgtatgccgttaaagcaacaatatcagctgcattattagaaataaaattaacggtgtcagccagcccactagcaaattgatgatgtgatgctaaaataattttacgtttcataattcacaactctcccctatgccttaaagatgcctaaaaatgttcctaccagtgatattgcaataactagtaagattatttttgttggtgtccatttcttattgcctaacaaatgataaattaataaagtcagtaatgccggcaacaatgcaggcatgattttatcaaaaattccggtttgaagattaagcgttactttacctaccgcaaatttaacaggcattgaaattttaaccaccgttgcaaccagagcgccaacaacacttagtccgacaattgaggcagattctgtaaaaatatttagtcgttcacccaatgacgtaataagcttcgtaccactggtaaagccaatatcaaacattttaagtttcacaaaccaaaaaacaatgtttgcaatcaaccaaacgattgcacctaatgggtttccttgtaaggccatataccctgaaatcgatcccataattgtcggccacaatacccagacaagcgtatcaccaacaccagccatcggtcccattaaacttgtcttcaatgattgaactgctgtcttagccttaataccatcacgctcttccatggctaatgaagcgcccaaaatcagcgaagacattacagttgtcgaattataataattaaaatgattttctaatgcttcttgatactcatcgtcatcatcataaatttttcgtaaggctggtgccagtgcccaagccaccgcaggtcccattttggattcataattaaagatattgcaagccataaaattatagcgtaccgcggcccgccgacgatcttttttcgtaatcttagttgttggttgcttattcatcataatcgtccccttcatcttcaaccacaccggcatttgttgctacttgactgacctttttggactcgcttaagaagtaccaataagctgcagcaaatccaattaaggcaacacccaagacatcaatcttcaaatatgccgctagcacaaagccaacaataatgtaactgaggaactttttgactggcatataccgtaatagcatgccaactccgactacaggtaacataccgccagcaacagttagtccgtttgtaacccaactaggcacaacgttcaaaataaatttgacaacatcggcgccccagaaaacaattagaattgcaggtaaggcagtttgcaaactgaacaaggccggaccccaccaggcttcacgacgcattttctgaaaatcatgcttttgaacatcacctaacatcttatgcgctaagaaattgacgatgatccgtgcaatgacttctaactggattgctaataatccaactggtaacccaacagcaatcgctgacttaatcccagatccagttcgtacagcaataaaaataccgacaattgttgccaatccgtaattaggcgcagacgcaccacctaaagcggcgacacctaacatcattaattgaaatgtcccagcaatagttaacgcagtgggtaaatctcccataatcaaaccagtaatcgttccgacaattaccgggaaccaagacataatcacaagaccgttctgatcaatcgtcatataccctgctaacaaaacaataagaatatcttgtaatatttgaatacctgacattattagttcctcctcgtctacgctttaaaaggttcttctggatcagttggcacgtactggattaccaaagggacatttttctgttccaatatttgcaaatcacgacgttcctcatcatctaaggcaacaaacttcgtaactggtttgcgaccgctttcattaaatagaataccaagatcaactttaggaatttcgacgccaccttcaataagcttaatcaatgtagcgggttcttttactaaaacaaatacccgttgattatcatacttaccagcgttgaagttagtaatagctttttccgtattgataatagacatcccagttccggctggcttagacatccgcatacttgctttaatggcctcgttagtacttaattcatcatcaaccaccataaaccgtttaacttgtaatgcttgtgcccattgattaacaattaatccatgaatcaaacgttggtctacccgtgctaaaattactgacataattaattcctccatttttggtatcgataccaaattatttattttaaaaagagcattaggctgatgctctcttaataacctttagctcaaatactgtttcagtagacgtttctgtgccactgatctgttttaacatgacttcggcagctgcttgtcccattcttttaaccggttgttgtacagttgataacgggatttttagattcgcagacattggctggtcgtccacgcccaatactccaatggcactaggaacattaattttgcatcgttctgcctcttgaacaacacccatggcaacttcatcactccccgcaatcaacacatcgggtcgtacattcagtgtcaatatttgttgtaatattttacgaccatcttcaaaagtatgagcgccagtgaataaccactgccgattgaaacgtaattgatgctcatttaatgaatcttgaaaacctgcaaaccggtccgaatcaaaatcctctccacgttctgtaatcacgatattcttacggccagtagcataggcaattttacgatacccttgatcatataaaaaactggttgccatataaaaacccttatattgattcgaacgaataacggggacatctttttcttttagatactcattaactaggacaatctttccatatttttgatatgctccaataactgcccatgagttttcaattgagcaaagaatcacaccatcaacttgttgatttttcaataaatttaatgctgtcacctcttcttctggtcgaccaaaagtctgaacaatcagcgtactataaccttgctcatctaaaacccgttcaatagcatctaccaaatatgcaaagaacggattcacgattcgtggaattgtaaccgcaattgtattcgttttagacccgcgcagttgccgagcggctggccgtggaacgtaacccaattcggtcattgctgctttaacaagatttctctttttacttgatacgtgtggactgttattgataacccgtgaaactgttgagactgacaaacccgctaactttgcgacgtctgaaatcgttgccatttacgccctccttaatagaactactttcttcattcatcataatacaagcttatattttgattgtcaatattttttggtatcgttttcatatttttctgttgtatttatttaaacgtaaattttatctaagaatgtccaaatgcgttttccagggataaaaaatgagcttaacaagattaccttgtcaagctcattttttcggtataattccgtatgattacagcttaaatcaatcgcaacttaatcttcatttttaaacaatgcatccaacaactgccccgccactggttgggcagtaccaaacattgggaacaagtgcggatacaagtacggcgccgcatgaatacccaagtataccgccatttcaggatgctctggcactaattcggcatagagattgggaatcatcacgtcgaccccagcgaccgctaagtgtaagtctgctaccaacttttccaccgcctgcacataggattgatgcatatcagccgtcgcgtctagcacgtccgccccgttaccaaaagtcgcatcctctcgtaataagatctgagttccccggctgaccacagaatctaaggtcaagtgatatgagtccaggcgataccgttcgatcgttcctaactgtagcgctgattgaggccacttaaaagcggtcccgcgcaacgctcgaccatttttgcgatcaagtaacgtcttgaacgttgagcgaccatcaccaacaatattggctggaattcgttcgacgattgcttgcacacgaccatcgataaccaaaaagcgataacttgatgcgactaccacttcctcggccattaccgcggacgtttgctcgaatagttgccggacgacttgttcaaacagtccgcgttcgggcataatccgaaagacaattactttgtgcgactcatccgccgcttttaatacgatcccaccagcttgaacgtaccgatcataatcagcaatcaactgattagctgtatgatatgtctgtgaagccggcaccggaaccccgtgctcagccagaatttgtttggccgctgctttatgtgtcagtacggtcgttagcgcctgtggatttaaatccgttccgctcccattcacaactaattgcgaccgtcctaacttagtcaatcgtaaaatgttagcgtgtgggtcaacaacgtccacctgcactccccgcgtcaaggcctgctgggctagttgctggctcgatagatctagcgcggtaaagcccgcaatttcaaacggacgttcattgctcgattcctgatagcgtgcagcccgttcgagtgcccatgctaacggatcggcttgcatggcaatctgcgcactcagcgtcttctttggatcagtgacccgcgacttcaactgtttgagtaacatggcatcttcatttggtaggccataggttttaacaaaatcagcaagtgcatctaaaacttgaacagccggcacggcctgagcactagccgtcgttggattttcacccaaaacttgacgggtcaattggtcagcttgagcgttgacttgggataccatcttagctggaagtgccggcatcattacgaaataactcgccaacaaacgaacaaatgccaccgcgttcgcgtccaccccgactggactagttggatcgagatccaagccccggtattcaagataatagaccccctgccgggccatcatagctagctgcccattactccgaagccgaactggcccgtcaaaatcattgaccgacaacaactgctgttgacgaacagccgccgtcaacttggccacgtagcgatcaattgacgtatagtctcccgtcacttgactgtagcgaccatcgggatgttgaacactactgcgctgtggacgactcgtagtatccgtaatggctaggcgtggtgaagcgccaaataaatactgaatcagccagttcatgcgcaccaatccctgagcgactttcagataaattgcattgcgaaagtcaacataactgtgatactgctgatggaaagtctcagtatataaacgggtgaataaagcttcattcaagctcatattcacgtgactaccagtcgtcattaatcgctgtaactcatacttacgagctaagtcgcgacgacgctgatagctgacttgatcaacatcagccagtggcacgttcgttagatcatccggcaacacaggcgtactcgacagtggccaaagtcgttcgtccgcatcgagtgaccgccgtgctgcggtattcaagcccttcagatacgccatcaatgcaggaatgtcacgacgcaccggcgtagtaaactttaaagcacttgcggaaaagcccggacgtaactgatgattttgttgcgctgatccaaacgcttgcgggtgtgctgtcgtcgctaagtgaccatggtcgtccacccggtgcatggtgacctctagtcctaaattagcctgatgaacgagtgggactaagtgatactgtacaattgccttaccaacggcatctaattccataatgatcaatcctttataattattttgttcgttaaactgattattcggtgtccttcattgtaaatgctataatagttgggactagttttgcaaggagggatttcaaacgatgcaacaaccattagcctaccggatgcgaccaaaaacgctgaaagacgttgtcggccagcaacaattggtcggcccaggcaagatcatcgcccggatggtcaaagccaaacgactatcatcaatgattctatacggcccaccaggtactggcaagactagtatcgcgagtgccattgccggttccaccaagtatgcttttcgcatgctgaatgcagctaccgacagtaaaaaacaacttcaaatcgtagccgaagaagccaaaatgagcgggacggtcattcttctgctggatgaaatccaccggttggataaaactaaacaagactttttattgcctcacttagaaagtggccgcatcattttgattggtgctacgaccgaaaatccatatattagcattaatccagccatccgtagtcgaacgcagatctttcaagttttcccgctcactgacgatgatattcagcacgcggtggaacgagccctcgctgacgaaaaaaacggtcttggcagttaccacgttgatttagcacccgcggccatgcaccacctgtgcaccgctaccaacggtgatttgcgcagtgccctcaatgggttagaattggccgtattatcatcgtctccggccgatgacggcaccatcgccatttcacaacaaacgattgaagaatgcttgcaaaagaaagccttatccgcagataaagatggtgacgcccactacgacgtgatctcggcctttcaaaagtccatacgcggttccgacgtaaacgctgcattacactacttagcccggctagttgaggcgggggatttaaagagtattatgcgtcggctgatggtgattgcctatgaggatattggattagctaatccagccgcgtgtgcccacaccgtcgcagctgttcaagctgccgatcaattgggatttcctgaagcacggattccgctagctgacgctgtgattgaattagccttatcgccaaagtcaaattcagggatcagtgccattgatgccgcgctcacaacggtccgtgacggccatttcggtgatatcccggccgacatcaaggatgcgcattatcaaggcgctgccaaactcggtcatggtgttggatacgattttccacacgatcacccgggtgattgggtcgctcaacagtatttaccagatgccatcaaatcagccaagtattacgagcccaaaacaaatggccgctacgaaacagcccttgcgcaacaatacgaaaaattattaaaggctaacgagagaaatcgctaacaataccttggttgtgctaataattgcaacttttatttttatatgctagactaagagtcgaaattactaaggtgtgcgcattgctctaaacaaagtgttgccgaacaattaatactactttgggatgtccgttagctaattccataacatgccttatcctttggtagttagcgaattagtcagaacgtcccacctgccttaaagcgggtcaatactgaagggcgattaacggcaccactagtttttccggaagtttacttccgttggtcaggacttgttcctggcctttttttgtggcgtgaaagcgacccaagttcacaacgtcattttactaacaccgtccaaaactcatggggagaatggttaattgggaagccggttatacatgaataatctcggctactgaaatacagtccatcacgctggtttgggtatttctgcaacaatctggcactcctgaacaattactcatcctcataaaaccagcatgacgtgtgtcgcaatcatttgacgctaaattgtgttgtgtgaactactagtactaatcgcttatctttagctagcattgcatttgtcttctcttccggaatcaactaaaataagattaacatcacctgttggaggttcattttgattacattactgcttgtcatatacacgctcattgcgggttggctcagttattatctgctgacgcaccagtcccgaccatttctcttttttgacccgaacaaagcgccgacaatcaaacacgtcgcacgctatggtggcggcttaatgttactagttaccatcgcctgtttcgtgaccatctttgttcaagcgacaatgctaattgccattgtactggctagcggttcactgattatgatggcaattgcactaattttagtgagtttcatgcaaatctcatagaaaacgctttttattttttgcgaaaacctttacaatatagttataaagtaatgaggggtgagaatgatgttacaacaataccaacacattttagttcctgttgatggttcttatgaagcggaattagcatttaaaaaggcggttgccgtcgcgaaacggaacggacctaacgcctcagttcacatggtccacgtggttgatacccgtgctttccaaaacatttctagttttgatacgaccatggttgaacaagtgaccgatactgctcaaaaaacgttggacaagtacgttgcagaagctaaggcggacggcttagataacgtggattattcgattgaatatggcgcacctaagacgattattgcgcgcgacgttcctaaggatatgggcatcgatttaattatgattggcgcaactggtctcaacgcggttgaacgcttattgatcgggtcagtcaccgaatatgtcactcggatggctgtttgtgacgttctcgttgtccggactgacttggaaaataagccagctcctaaaccaaagaaaaagtaatcttttgatacacgtacaataaaaatcggctcagtgaagttacttacctcactggccgattttttactatttgccaaaatcataccgcttactgctctaaaattgcccggtaaagctcctgaccaagctcattcatcgcgaccatttgcgcggtacgttccccactagcagtcatcatcgtcatgataaaagtcccctgacgattctgaacgatggccgcatcattttgaacaccgtatgcttgatagtccccagttttgttatagatcgtcgcgcgtgttggcagatttttgaccaacttactgtgatccgtgttcgccttcaaaatcgttaacatcgcgtgatcggctttgttcgagatcaaacgcaggttcgccagtcgtttcagcaccgttgccacatcccgaaccgaagtatcgttatcatgcccggcctttagtgcggcagtatccattaaccgccgagccatttttgtatcagtcagacccaactgtgcaatttccgtgttgaccgccgagaagccgccaacacgatccaacatgatattagcagccgtattatcactctccgtaatcatgcgtttcgtgatttcagcatacgtcaactggcttccagctggtaacgtgtgcaacgtcccggttccaccaactttatcggcagcacgcagggtataacgatcctgcatgcgccaattattttgatggacctgatcaaaggcagtgaccataataaataacgtgatcaaactgccagcacgttgcgatcgattattcaaaactacggtctggctacccgttaatggcatcaccgctaccgaagtttgaccagccaacccattcgttgcttgcgcaaccagatcagtaactgtcgtagtcggaaatgtcggtgttgccttcatcggtgcgtcagaatcgctggcagccggcttatgcacctggcttttacctgccgactcggcagttgccgatgtcgtagacgaccacaatagttgtcccacgatatagccgccacccagcaatagtaaccccgcaattaataccccaaggagtgtttgtggcctaaagcgactcgaaaaagttgtccgccgtgattgttgacgccgccgctggactcggctttgctgattgacatcaccattcactggcgttagacgatgaccacattttaggcaagtcacggcatgcggtgaattttggtaaccacagttttgacaactcatcttcacatttcccccggtattaaaaataggacagtcagcggtgtgccgtgcctaatgggaaccgcaatatctcccattaagcgcggccgttcaccgctaactgtcctatcacgttatctaagcgtcgttagccacttgcaagggtgcaatatggtactcggccatttctttcgtgattttttcggtcaaactactgttatgtgtcaccagacttaacgcatacgccacgtaatagtgatcatgcgctgactggacattatttaaaacaacttcattggccgccttttgtgcatacaaacggtctaataaataaagtgactgactctcctgagccttcttgagtgccaagtcgatcaactccaaagcttcctctggaaaattgatcttagcatacaattgtgcggctgaggcgtaaatcaaaatttcattttgtaagtaatcgtcgtcacccatcggcattgcttgcgcatccattgtgtgtaaggtagcaactgcctgtttgacaaaaatttcagccttgtcataggcctgcttacgttcataagctaagccggttccaagtgtggccaggatggcaaacatatcgtgactagacttgacgaactgattaagcaacattccaaagttaaagatggcttcgtcagcattgtcattgagcactaattgaagatagccctcatagtaataatactgtttcttatccgtattactacgtaactgcttcggacggatatgctggaacacatcctgagcctcttccagttgtgtatgtcgaatcaaagtatcaatttttttgaaggtccgatataactggtcgtcattttcaataatgacttccgataaacgaattcctaatcgattacaaattttcatcataatcttcatacttggaattttactttttttctcgattagactaatcgttgcctgagtacaaatcccatcagccagttccttctgcgacatgcccttccgctttctgaactgccgcactttttctcctaatattctcatgcttaacccctcttcattgattgccttaaaccaaactcattttgtaactccccttgctgcccccactaaatgaacaagggtatcgtgacacctaatcaatcctcgttaatccgttcgaataattgagcactaaccaattggacaataccaattacgcatataattatattcacataacggaattttagcaagaaatacgcgtaattcttatttaatattaagtttataccatgatatcggccgaaggtcatttattaattatccaggcttacagttcgttaaccaccctaatcaaggacttgttcattaaaagtgagaactactgaaagcgatttaaaggggagcgaattaaccttattaacagcaaacatcaattgtcatgacaccctcaattaatcggttgacgtggcttaataattaagattagttctcatacttctttcagtagtttataaccaactaactaaccaatttatcaattgataaaaataataatgcttagattgaccctgtaatcttcgtaattggcccggtcgatttgtgatcagcccgtcagcccccatggccgtcagtcgctgcattgcaagcggccgatcaacagtccagaagtagacgatccgatgttggcggtgggccgcactgatctgctcacgggtcgcggttagtgcttgtaaagaataaaatcccgcgacggaattagaaaaatccgtcagataaaacggcgttatgaagccaaccggtagttgcgccgcccgttgatgtaatcgttcaatcacacgatagtccaaagagtgtaccgcccctttttgttgtatcagtcgttgtgcatagttgtcggcaaaaatccccattagttgatcagccgtcccaactgacttgatttcgactaataaaggttgctgtaatttgtgtgccaccgcaaagtactgcttaaacgtactcaagtagcctttttgaccatgctcccgtagtggtaatccactcaacttatcaacggggtactcatgaacgggaccgggttgacccgctaaagctttcagcgttggatcatgcatgacgacccagtgacgatccgctgtcggctggatatccatttcgaccatatcaggctgaacttgctttacagtccttttaagcgccgctgtggtattttggacaccgtcacgaccattaacaccccgatgtgcaataattgctagcggcgccgttggtggcgttcctagccaccagcctgcgtaaccacccaagactagcaaaccggtcaacgtaagtagcccagtttgccagttagagtgaccggcgattgctgtttctggccaaaagcacgaccaccatcccataaacattaaccaagccagcagttgcaacccagtcatcatgaaaactgcaataaattgactgaccagctggctaacagcgccactagcccacactatgccaccactaatgattgccataacgagccagctaatcaggaacagccacacatttcgactttttttaaagactgtccaccaggaaatccgccaacccgttcgccaataattacgccagctggtcggagcggtcaattggcgttggagtgctggtaaccacttccagctaatcagccagcccaacagccaaagtggtcccgccacaggaagccagtcataacgcgtattaaagattatattttgaacagtcgctggcaattgtatgctcgcttgtaaagttgctaaatagcctaaccaaccgagtggtaaccaccacaccgccgtaaacattaacagcacccagcgatacaaaaattgaccggcctgccacgactcatgattactacgagcgaccatggctggtaaccaggcactcaaaagcaacaagcctagcaagctgactaccccaccgaccagaatcccgagcaccttagcgagtaccgccagcaatatgccggccaaccaccagcaggctagcggtccagccagttggcgcgctccctgcatcactaagtgccatccgcgacttaacaacctgacccctcctcacaaaaaaaggcggccgtgatgaatcgcttcatcccaaccaccacaaaactcattactatcttattccgcgtctaacgcaacgaaatcatagtgaatatcagattgacgtttgaattcatcaaaaccaagttggatcaattgatcgatcaacgccgtataactaatgcccgaaacttcccatagctttggatataaactaatgttagtaaaaccaggtaacgtattgatttcacccaagtatggttcaccatcttcagacactaagaaatcgacgcgtgccattccttttagaccaagcgctttaaacgcgtctagcgacatctgttgaatccgtttcgtcaaatcagctggtaattcgactggtaattcgaacgttacaccactcgcatccacgaacttattattatagtcgtagaacgtgtccgtcttcggcacatcaatggcaccaagcttagatgccttaggattttcattgcctaagatcgagcattccacttcacgcggattgtcaatcgattcttcaactaaaatcttgtagtcatatttgaacgcatcggccaaaccatccaagtattcttgttcattctcagctttatgaatcccaatcgacgatccttgattggctggcttaatgaataaatgatcacccacgtgggcttgtaaataagcgtacgtcatttggtcccggttttccggtgtaaccaccacgtacttggtgttttgaatatgatgatgcgttaaaatctgcttcgtaatatccttgtcaaaactagctgccgacgctaagacaccactaccaacatacggctttttcaataacttgaacagcccttgtaaagtaccatcttcccctaagttaccatgaaccactggatagaagatatcaatatctttggccagtgtcaggttcttgatgggagctaatggatcactcatgtccaactttggcatttcttcggcgacgacttgatcttctggttcaccatcaaatacgcgccgagttgcagcatcactcaagacaatcccgttcttcgtgattaaaaacaagtcaatctcgtacttattcttgtccatggcatcataaatgttgtgcgctgaacgcttcgaaacatcatgttctgaagagttaccaccaaacaacataccaacatggatctttttttgtgtctccataattttgttcatcctatcaaggtttatttcatactacggcttagttaattctacaatatctgagcacaattgaaaacatttttacaataaaacgttgttttttacgcgtcaaatggcgcagtcaagacaatcttacccaacatttgccccgtctctacgattgtgtgcgcagttcgcaaatttgctgcattaattccagctaaagtccgcttggtcgtcggtacaatcaccccggcatcggccagttgcgctacctgtgccagaatactcccctgcgtcgccatcgatggcaactgatagttagccttcgtaaacataaactcccaagcaaaattcaaacttttcggctttagtaacgccattggcaaggggtgctgatttgtcactacggcgacgatcgtgccaagtggccggactagcggtgtcactaatggcaagtattgatccgtagagtgtaatagtatcgcatgatcgacagcctgcaaaccggccgcagctaattgcgatcccagatcttgatggtaatctaagacgatatcagcacctaaccgcttaacccattcagtggtttctggcttaccagtcgtcgtaataacttgaagacccgcccactttgccaactggatggccatcgagccaaccccaccagcaccattgatgataaggacgctctgaccaagattcgcgtcagccgctgcagtgaatggtaatttttcaaacaatgcttcccaagctgtcagtgtcgttagcggcagaccagctgactgcgccggcgaccacgttttcggggcacacgcaactaaccgttcatcaaccaattgatactgagcatcactccccggccgatcgacggcgccagcataataaacgacatcatctgtcataatcgttgtcactgcttcaccgaccgccaacactttagcaacggcatcaaaacctagtattcgcggcgttgtcactggcgattgaccttgccgctgcttcgtatcgattggattgactgcggttgctaagacggctactaagatatcacggccacgaggttgatttacattaatggtgacatcttgtaaactattcggatcgctcactggcaacccttgcgttaatccaactgcttttgcctgcattcaaaagacttccttccaaaactaacctaaaaattctaattcatcatccaaataatctacgacggccgttggcagatcatcgtgtaatgcaagtgcttccaataatcgattacgattgaaaatctgcgtccattcagcttcactagccggacgagtatgcatcatcaactgctgatgccagtccttcatcgcagttaacaaataatcacaataaagctcatgtttgtttgtaatcaaggtcaaataagtcgatagtcgttctggctcgccaaaaatcaacggcgttgttaacttttgataacgagcaatcaatgcggccaacagtaataatttatccgcacgtgcgagttgagactcatctgccagttcatctaagatattgccaatatgcgtgtacgcatgcgcccaaccggtggtgcccacaaacccccgagtatccttttcgagtaaaatgtagactgtcatttgctcaacaactagatccagccgcgcgggtgtcataaacttgagacccgcatggtccgcatacaagagcactgacagtaatagtatcgcaaatgaccgctgataaatggcatcattttgcggctcatcgatgtgtgcaaataacatctgatcttgaatcaactgatcaaaaatatcgcccaactgttccggtgtgagtacctgctgctgtaatgcctcgtttaacaaatagtagacgccttgatcacgaaccagcggattcagcgaaccaacgtgtgccatcaataatttgatttgatcctcgctcatcgcggtcaacgtgcctttcttcaactgctcatgaagtgttgcaatcagtggaagcacctcttcgtcgctcggaatcgttaccgtggttgtcacggtactcggtaactgcttaatcagcgttgccattcgactgggcagtgactgatagatttgtcccgctcgaagttgttgtcttaactttaacactgcatccttaacctgcatcaatttctctgcttgcataatgacctcgtaatctcgaatttaccttctattttagcatgtcagcgcctgtctgcccaaaagaaccattcaatcataaaacgtgacctaattatagacgtcacgaagccaacctgagccaatacccaagtccacaccgcacaccctgattaggccacgtttaatgacaagatgtttcaatccatgcttagaaaaagcttatgcttgcggtaaaacgtccacttgcgacttgataaacttcgctgacgctgctaacaacgctcgttcatcagtggtcagatctagttgaattaatgattcaatcccgtttttaccaatcacagcaggcatgccaacgtatgtcccatattgcggatcaaaagctgaaactgggcaagccagttgtgcatccgcgctgacagcttctgccaatcggacaccacaagtagcaatcgcaaagtttgtataatgcttacccgccatgactgcaaatgccccttgccttgcatcttcttcaagttgatcaaggttcagacctgggaaatttttgataggctgcccattgacgctaaccgttgaccaagctacaaattgtgagttgccgtgttcgccatatacgtaccccgcaacatttttaccattcgtaccagctgcttgtccgacatacttttgcatccgcgccgtatctaagaaggtccccgtaccaaaaacccgttgccgtggaaaacctgtcattcgttgtaaataatccgtcatgacgtcacacggattcataatatcgatcaaaatacccttgaagccagatgccacaatcttgggcgcgatctcccgtacaatcgcttggtttaaatcatactcaccaaagcgacccttggaactattcatatcaatggcaccaatattgccagaagccacgatcaacacttcggcatcggccaaagctgaataatcgtttaaaataatcttagtggttgagcttagacgaggtgacgcgtcgtctaaatcgagtttttgcgccttggccaaggcctcattcttatcgattaaaactaattcatcaacggttccttgttgaaccaacgtataagccactgtcgcaccgacttggcctaacccgatcacaccatatttacgcatgctgcaaaccccaatctgtagtttatttaacttggttagcgtaccttgcaaccgctataaagtcaagcaggacgctgtctcataagaatttaatcaatagtactacttagataatatcaaatgtgcattttcattaacccgcttcggaaagttaccgtagtcaaactccgtgaaaaaagctagctcaatcaatcaatattctgatttaagatggtccgtttagtcggccgaaactggcaggatggcacccttgtacttcttttcaatccatttctgggtgctcttagaacgtaaagctttcattagtttcttaatagctggcttgttcttatcacccttacgaacagccacaatgttggcatatggtgaatctgatttttcaagtgcaatcgcatccttcttaggattcaacccagcttgaaccgcgtagttcgcgttaataacgaccgcgtcaccctcgttatttttgtagaatgttggcattaacttagcttcgtatgaatgtttaaacttcaaatgacgtttgttggtcttaatgtcattaaaagttgctgaagttaaatcagtcccttttttcaaagtaattaaccccgcatccttaaataacgtcaggacccgaccatagtcagccacgttgctgctgaccagaacggttgcgccgtctttcaagtcttttagactcttaactttcttggaataaacaccgattggttccaagtgaaccttccccgctgatacgaggctcccattattttccttattccagttatccaagaatgggatgtgttggaagtagttggcatctaattctttcgaagccaatgccttattaggtaagacgtaatcttgaaagactttgatcttcaagttaacgccttcctttttcaattctggctgcacgtgcttcaagatttgtgcgtgtggcactgaagaagcccctacagtaatggttgttgtctttgttgacgatgacttcccacaaccgactaacaaaattgccgttgccgcaactgctaataatcctagaattcccttttttttcataattccgtttcctcctatacgaactttaattaacccgtttatcaatatgccgaactgcaatatccccgataaattggaagataaacacgataatcacaatgattaccgtcgccactaatgtgatggcgttgttattggactgaaacccgtcttggtaggccaaattacccagaccaccagcaccaatggctcctgccatcgcggtgtagccaattaatgaaatcgtcgtgaccgtgattccagaaactaatgccggcatgctttctggcaataggacttttcgaataatctgccaccgggtcgcccccattgattcagcggcctcaatcactccatgatccaattcatggaaggccaattcaaccatccgcgcatagaatggcgcagcagaaataatcagtgatggtaaggccgcgcgcggtccgataatcgttccaactaacttagacgttaccggcaataatagcacgatcaaaataatgaaaggaatcgaccggaaaacgttgacgaacagcgcaacaatccaattcaaggccttagccagcggattctgactccccgccgtctcataaagtaacagacctaaggcgattccgagaatggcaactacgaccatcgacacaatcgtcaaccaaattgtttcccacgtggccgacatcatgctaccccaatcgacatttgcaaatttaaaatatgaatctaatccttgatcattcacggttcaagacctccgtttccacccgcatcgtttgtaggtacgctagagcgcccttaatctgttcctgatcacccgttagttgtaagtacagcgaaccaatcgccccttcttgggtttggtgaatcccaccctcaataatatttaaatctaacggatacttcttcaacatctctgaaacaatcggtagctgggcttgatcgccatggaacgtcagttgtacgatggttccctttggatatttcgccagcagctggtccacgaccaccgttgtgtcattcagcgacggcgtgacctcttcattaacaaaccgcttagtcacagcctgctgtggtcgcttgaagacttcaagtactggtccttgttcgacgattttaccagcttccatcaccgcgacatgatcagcaatcttgcgaatcacgtgcatctcatgcgtaatcaatacgatcgtcaaatggagcttctggttgatcgataacaacagatccaacacttcatcagttgtctgcgggtctagggcactagtggcttcatcagaaagtaaaatctgaggatcattcgcaagtgcccgggcaatcccgacccgttgcttctgaccacctgataattctgacggataagccgtttcccgaccggccaacccaaccaagtctgctaagtgttcggctttcttacgggcatccaccttggacagaccagcaatttcaagtggaaacataatgttctccaaaacggtccgcgaccataatagattaaaatgttgaaaaatcatgccgatcttttgacgttgggcgcgtaacttggccccgctcaacgttgtaatattgacatcatcaatcacaactgacccactagtgggtgtctctaagccattcagcatccgtaccagagtacttttaccagcacccgaatagccaacaatgccataaatgtgaccatcttcgatttttaaattaacatcttgaacggcgtgaaccgccccttgcttagcatcaaaggttttcgtcacatctttaaattcaatcaagtcaattcctccttacgcatcaaaaaaagctcctcatcccagacaattacgacaataatcatcaataggacgagaagcttagcctcgtggtaccacccatcttcacaactagctcacgccagttgtctcaagagttactttgaactccgcatgataatgggtgcgacccaagcttagcttgcgactgctcactaaacttcattacttcaagaccatcttcagcttcacgattaatcccctttcaccaaccagggactctctaagtaatcataaccgcgtactcatcttttcaaaatgataacttttttaatcaattgttaatgtaacgagtataccgagcctgtttctaattgtcaaggcctggcaattagtccacgtcgattaaccaagcaacgccgtcttcaacgctatttaacgcatcgaagttctcactcaacgccgggttgaccgcaaccacggtcccattgattggacagttgaattcagaaacggctttggtcgcttcaacgctcagaaaagcgctgttctgactgaccttgtcaccgatagctggtaactcagcatatttcacttcaccaagagcctcatgggcggccttagttaaacctaaccgcgtatgtccatcaacgtcttttgtccaaaaataagctgcatcttcactcatactaaacaccatacctttacaataattttactattcaaaccggtcgttacgactgaacatgtaggacttgtaatgatatcgcatcgacatcattaaacctatcccagccatattggcaatcaacgccgaacccccttgactaataaacggcaagggaatcccagtcattggtaacagtccgatactcatcccaatattttcgaacacgtggaagagaatcatcataatgaccccggttgaaatgtaagcgtagaattcgttcttcgtatcaaacgtcactcggatcatctggtaaatcaataagaaatacaataaaatgaccacggcacaaccgataaagccaaagttttcaccaattaccgagaaaatcatatcagattcacgcacaggaacagtcacgtgggaaacgttaaatccccgcccagtaatctgacctgaaccaatcgctttcatactctgccaaacttgataagcattgttagacgtgtccgtcgacggattcaaccacgtatcgatccgcgcaaattggtattgcttaaaaccgatagcttccaaaatatggcgaccactctgcgagatcacgagatataacgcagtccccgcaatcgccgccacaatggcaaacgtcggtgccaataatcgccacgaaatcccagaaactaagataacgcccccaagaatcgcgaagaacaccagcatcgtcccaaagtcattttgtaacttcaaaaggatagcaactggcaccatgtacgcaattaacttcccaatgagttgccaatcgctcgccatcgtatgtgttgggtgctccgtgttatgcattgtcacgactcgtccaagcatcaagatgaaggcgggcttcatgacttcagacggttgcaacgtcaaggaaccaactgcgaaccaacttttagccccagtgctcgcaaacagtgatctactgtacaagaccaaaacggccgcaagcaggaagatcccaaaccaataggcaatcggtgccactcgccataactgttccgaatcaaattgcatcacaattacggcaatcgcggtcccaatcacgaaccacatgacttgagaaatcacctgcttcgtgacgtttactgaactagagtcgtgcactgcggcgacataaatcgacgccagcccgatcaatcctagcatcatcactgaaaatatgataccccagtcaattcttgaatcctcgtcttgactgcggagtctagattcttctgccacaaataacgctcctaacctgttgggattagcccaccgcacgcgtcagactaaccctattcacaatatcattttgtactttaagatagtttttattatacaacaacctggtgccgaattctcggaaccaggttgaaggtttactaaaaattagcctttgtgtagatggtaagccgacaagatctcttgcagactctcatcaaaagatttggtatgcgcaaatggttggttgtcactaaccatttcagcttcaaatcgttcaccgacttgagtcacttgtccaatcacttgtttaccgatcaaaacttcggtaactggttgaccgttgaccttagtttcgtttaaagtgaccgaaatcgccttatcttttcttgccacggtggtcttcctccttgtattgcggattacgacgcaatgaaaaatgggctggtaccggatcaaagccgcccttaactaagggctgacaacgtaagatacgtgcaactcccattagaacgcctttaactgcgccaaaccgatcgatcgcttctaacgtgtaattagaacaggttggataatagcgacaatgagccggactaaacgcagaaaaggcccgctgataaaagcgaatgcctttcattaataaccgtcgcatcgtaatttatttcttgttcttagcagttttctgcatatgttcaagtaaaattccagccccctgagcaacgttgttcaatgggtgttcggcaaccattacgggcacctttaagttttcactgatcaattgatcgaggccactcaacagtgcgccaccaccagtcaacgtaattccacggtcaataatatcggccgcaatttctggtggtaaagtttccatcacgtgatgggccgtgctaacgatctgcatcagcgtttcgtgaatagcttcttcaacttgattggagtcaatgtcaattgagcgcggcatccccgtcacagtatctcgaccacgaacttgggtgaccttatcatcatcgccgtcctgcttgaaaacttgtgcgatttgaatcttaacttgttctgcactgcgttcaccgatcaacaagtgatgttgatctttgacgtagttcacgatgtcctgattcatccggtcgccggccattcgtaacgaactacttgccacaatgtcacctaatgataggacagcgatatcactagtcccaccaccaatgtcaatgaccatgttcccacgtggttggaaaatatccatccctgcgccaatagccgccacttttggttcaacttccaagtaaaccttgttaccgccagatttttcagcagcttgcaagattgccttgcgttcaatttcagtagtgttcgttggggtacagatcatgatacttggccgcgacataacgccacggacatttaattttttaataaaataggacagcatttcttcggtgacatcaaaatccgaaattactccgtcttttaatggtcgaattgcccgaatgttactaggcgtctttccaaccatttggtaggcttcggacccgactgccaacacttgattcgtgttcgtatcgatagcgaccacggatggttcgttaaggacgatgcccttacccgatacgtaaattaaaacattggcagtacctaagtcaataccaatatctaaagccatgtttttgctcctctcaaacatacaattatacgactaatcattataccatactctacagttgatgagaactgacggctgtcctagctactcgttcatttgtcactaccaatcaattggctgtgcctaatcatcctgtcgtttcgaccactcatcgaccgtcagcgaataaattgcttcatcacgatattgaccatttaacaagatattttctggcagggtcgcatccaaatgatattggcgtcgctcagcaacagcccgacttgcctggttggcaacgtctgcacctaagatgaccttgtgcagatcaagctccgtaaaagcaatttcttctaatcgttcgagcgctttagtcatgacgccacgaccagtatatttctggcccagccagtagccaatctcaccgttgtgattaatggcactaatattatgcaagtctagcatcccagcgacttcgccatccacaatgatggtggtgataaacacctgtccatgagcctgcttggtcaacattgattcgataaaatgacgctcgtcttgcacggtcgccgtcgcatcaacccacggcatccataacttcaaatggtcgcgattatgatcaactaagtcgaaaagcggctccgcgtcagccacttcagttggtttcaatgaaatgtgtttgtcgataatattaataaacataagctgtcctcctgaatgttggcgccgggttaccccgcttcgccacaaaaaagccttcaaaaacgagtttatcgcactttgaaggttttgtaagcatttatttcgatttattccgcagcttcgttcgcaaaatcaggattcaacgcataaacggtgccatcgggaacatcaactcgtttaatctcagcacctaatttagccagcttaccatggaagttaaagtagccccgatcaagatacttcaaattagtcacttcagtgtaaccccgactgaccagtccagcgattactaacgctgcagctgcccgaagatccgtcgcagtgacctgggccccgttaaagtcagtgggaccatacataatgacggagcgcccttcaactttgaagtcggcgttcattcgccgtaactcatcaagatgcatgaagcgattctcaaaaaccgtttcagttaataaactagtgccctgcgcacacaactgcaaaattgtcatttgtggttgcatatccgttgggaaacccggatggggcatcgtcttaacggaggttggcttcaagatttctggaccaataacccgaataccagccggttcttccgttactgtgacgcccatctcacgcatcttcgagatcaatggcttattatgttcggcaatagcatcctcaaccaagacgtttccctgagtcaccgcagcagcgaccatgaatgtcccagcttcaatccgatcctgaacgatactatggtcacagccatgcatcgctttaaccccttcaatgcggatcgtttcagtaccggccccggtaaccttagcgcccatctgattcaaatagttcgctaggtccacaatttcaggttcacgagcgacgttttccatcgtcgtgatgccatctgcaagtgttgccgccatcattatgttctgcgttgccccaacacttggaaaatctaagtaaatggccgctccgtgtaactggttcgcggttgcttcaacatagccatcgtggcgttcgatttcagcaccaagcgcgttcagtccctttaagtgtaaatcgattggtcgtgaaccaatcgcacagccacctggcatcgcgactttcgcatggcctaatcgtgctaatagtggtcccatgaccacgattgaagcacgcattttggatacgtattgaaatggtgcttcggatgataattgacgactagcgtcaatatcaattgttttattaatttcatcaaaatcaattttagtattcaaaaatttcaagacgttgttcattgtaaaaacgtctgataacactggtacatttgataaatgtgtctgaccagaactagccaacaagcttgcggctaagattggtaacacggcatttttagcgccctcaatatggacatttcctgtcaaacgttgaccgccatgaactacaatttcctccatggataaaccctccatcactaaacgataatcaacaaacaagttacgtgagatttcggattgcgtaaaaagcacacttactaaaagaacccgattggatcagatgcctcgcacctgcccaaattccactgttcaccgctgtactaagcaaatcggcaacgcgcggtgtgcaatccaaacaccagctcaaccatcaaaacaacctggacacaccatggcaacttgccaatagcagcatgcaggttcaaatcggttcctaatcatcataccatcgaacactagtggataaatattacattttacattttcgttacaatttcaacacaaatattaaatacttatgattagttaactaattagaagtccgtcgtgcaattatttgacaagccatacccatattgattagcagtatcgttcgtttgtaatcgttttctttattgtaatctcactataagttgcattctaccattcaacttatcgcaatgcccctaatacgctcaatcgattagtaaaatctagttcacgaacatccgcgccgactggacaaaacatttcaacgtcgcgataaaattggccactgaaacgtttaagttcgatgtaaacttagttgttcatgttccctatgccgacctttggaaattgctgccaattgtcggaatgtgatgatcacccatttaagtcgcgatccacgtcttaattactgctctgccagatactgatgcaatgttggcgaaaaatattcgaatcagaccgattcttctagttaacaacgcgatatcgccattagtaagccagtgcttggcccttgatcaacccacggttccaatctgctttgaaccgtgcaagcttaaaactggacagtaacgggtacgactcaccgcggtaagtttgactaacttgtgcatcgcggcttaactgaaccgcacaaaaaaagcacccgcaaataattgcagatgcttttcagaattttaagttgttaatgccgagcaacattcaaacggttcatggcacgccgcaaagcgacttgggcccgcgccaactcagcatcatcgtgcttttgttgggcattttgaatccgtgtttcagcgcgtttccgtgcattttcagctcgagcaacgtcaatgtcattctgacgttcagcactatcggcaacaatcgttgccgtattattactgaactcaacaaaaccaccattaacggcaatttcgtcatcttcctgatcactttcaagttgcttgatccgaacctcatcgattgcaagcgatgcaatcacaggaatatggttcggcaaaattccgagttcgccgtcaatcgttcgcacgatcaacattggcgtcttattctcatagacctgaccgtctggagttacgatgctaacggttaatgattttgcattgtcagccatgtaaacccctcctaatcagttaccatcgatttcgctttttcgaccacgtcgtcgatcttaccaacttgacggaatgcgtcttctggtaggtcatcatatttaccttcaagaatttctttgaagcccttgatggtatcgttgattggcacatacgaaccaggttggcccgtaaagttttcggcaacgaagaagttttgtgacaagaagaattgaatccgccgtgcacgcgcaacagttgtcttttcttcgtcagataattcatccatccctaaaatcgagataatatcttgcaattcacgataacgttgcaagacccgttgaacttccgttgcaacttgataatgttcttcgcccacgattgatgggtccagagcgattgaagaagaagctaatgggtcaacggctgggtagatcccttgttccgtcaaagaacgttccaagttggtcgtcgcatccaaatgggcgaaagtcgttgcaggtgccgggtcggtataatcatcggcaggcacataaacggcttgaatcgaagtaactgaccccttcttggtagaagtgatccgttcttgtaattgacccatttcagtggctaaggttggttggtaaccaacggctgaaggaatccgaccaagtaaggcggaaacttcagaaccagcttgcgtgaaccggaagatattgtcgatgaataacaacacgtcttgaccttgaacatcacggaagtattccgcaatcgtcaaaccggtcaaggccacccgcatccgggcaccaggtggttcgttcatttgaccataaaccatggcggtgttcttcaaaacgccggaagccttcatttcgaagtaaaggtcattcccttcacgcgtccgttcaccaacaccggtaaacacggaaatcccgttatgttcttgggcaatgttatgaattaattcctggattaaaacagttttaccgacaccggcaccaccgaacaacccaatcttaccaccacgaacataaggtgctaagaggtcaataactttaattccagtttccaatacttcagtactggtcgttaattcatcatatttaggcgcatcccgatgaatcgggttacgttctgcgtctggaccgaattctggaccaccatcaatggtttcccctaaaacgttgaagacccggcctaacgtctctttaccaacgggaacagtaattgaagaaccagtgtcttcaactgtcattccccggcgcaagccatccgtaccatccatcgcgacggtccgaacaaccccatcacctaattccaacgatacttccaccgttaaagtgtcatcgttgtccttctgaatgatcaaggcgttattaatatcgggtaacttatcgtttagagagaattcaacgtcaacaacgggtccaataacttgtacaactttacctgtactcattagtcgttaattcctcccacttcgttattcttgcgcaaccaaaccaccagtgatttcagtgatttcagtggtaatagcagcttgacgcgcacggttatatttcagatttaatttatcgattaaatcgccagcgttatctgatgcagccttcatcgcggttgacgacgaagcatgttcagcagtcttggcatccaagattgcaccataaaccaagctttcagcatattgtggcaacacggccgacaaaatggcttcttctgacggttccatttcatactcgggaccgacatctacccggctatccttggctttacgattatctgactcactttgttcaaaggtctcttcggagatcggtaacatcttaacggcccgaaaaccagaagagagccgattaataaagtggttgtagaagacgtaaagttcatcaaagacttcgttgtggtacattgatgtgactgtcttaacgatttcacgaacctctttaaaagttgggacatcagagacgccgcggtactcataagccacgtttaacccgttctttttatagaaatccgcaccagtgccaccaaccgccaaaacgactgcgttatcggcatcaaccttgtgcgtccgcatgaaatcgttagtctgtttcaacacgttactgttgtaactaccaacgaggccacggtccgaagtgatcaccaataaaccagtctttttaacggggcgttgcgcgagcaattcactaactgaaatcgtgttcgaattactgttagcaacaccggcacttgctgacatcagatgagctttggcaagatgtgaaacgatgctttcaactttagaagcgtacacctgatacgtgctggtatgcttttgaatctggttcaattttgaagttgagaccatttgcattgccgacgtaatttgatgagttttctttgttgagtcaattcggcgcttgacatccattaatgattctgccatgcactactcaccatccttttcagccataactacttcgcagcggcagcggttggctggaattgttctgcaaacgcatctaaggccccattcatcttatcagcttctggtaacttcttggttgccaaaatcgtatcaaagaggtcctgatgactagcatgaataaattcaaacaattcactttggtaacgggcaatatcatcaactgccactttatccaaataaccgttggtcaaagcatataaaatcattacttgttcttcgaccttcaatggtgaatgaacaggttgttttaagacttcaacgatccgttgcccacgatttaatttcgcttgggttgcagcatccaagtcagaaccgaattgtgagaaggattccaattcacgataagaagccaagtcaagacgcaaggtcccggcaacggacttcatcgctttaatttgcgcatccccaccaacccgggaaacagaggccccggcatcaatcgctggccgcacacctgaatagaatgaatcactatccaagaagatttgcccatcggtgattgaaataacgttagttggaatataagccgaaatatccccagcttgcgtttcgataattggtaaggccgtcattgaaccgccacccaattcatcgctcaacttggcagcccgttcgagtaaccgtgagtgcaagtagaagacatccccaggataagcttcacgacctggaggacgacggaggatcaaggaaagttcacggtaagccgttgcttgctttgaaaggtcatcatagacgatcaaaacgtgcttgccgttcatcataaattcttcacccatcgctgccccagcataaggagctaagtacagtaatggcgctggttcagcaggtccggcagttacaacgattgtgtagtccatcgcacctaacttcttcaacgtttcaacttgggcccgtacagttgagtccttttgaccgattgcaacgtagacacaaatcatgtcttggtccttttggttcaaaatggcatcaatggcaacggacgtcttcccagtcttacggtcaccgataatcaattcacgttggccccgaccaattggaactaaggcatcaatggccttgatcccagtttgaagtggttcgctaactgattgccgttgcataataccaggagctttatgttcgattggccgcgtattcgtggtcttaatctcacctaaaccgtcaactggttgacctaatgggttaacgacccggccaatcatggcgtcaccgactggaacttccatgatgcggccagtccgcttaacagtatcgccttcacgaataccatcaaaatcccctaaaacaacgataccaacatcgttgctttcgaggttttgtaccatcccgtaaactccgttactgaattcgagtaattcaccttgtaaggcgttgtcgagtccgtgagcacgggcgatcccatcaccaacgtaggtgacagtaccggtttcagcaactgagagctcagtttgataactttctaattgttgtttgattagagcactgatttcttcagatttaatgctcataaaagtttcacctcttcgtaaactaattgttgatgagtgctcgtcttaaattcgttagttgtaacgcaacgctaccatcaaacgtttgattatttgacttcacaattacaccgccaatgattgcttcatcgactttacgtgacaaaacaacctgattggcaccaacacgtttggcgaatgcctttgcgattgcatcagcttgctcatctgacaacttgaccgcagacgttacttcggcatgcactattttgcgactctcatcgaaacgtgcttcaaacgcgtcaacaatgccaactaagttcgacatgcggccgtaatcatacaacatttgaataaagtttttaatgtattctgaagcgtggtcagtcaaagttgacaacgttgtctgtttttgatcaaccggaagcaatgatcctgagaggacctctgccaattgcgggttgtcgacaaagacttgccgtaattgctttaactcggccaggaatgcttcggtctgatctttttcaactgcaagttcaaagagtgcctttgaataacgacttgcaattgtaagattatcaagactcatgctttcccaacccttcaatatacgaattaattaatgcctgttggccttccggatccaattgcttcttaataatcttcgtagcaatcgcaaccgaaatgtcagcgacgtctgattggacgttcttcaaggcatcttgacgctcctgttcaatatccttacgcgcattttgtttatactgcgttgcttcgttttgcgcatcggcaacgatacttgaccgttgcttttcgccactctttttcgcgtcagcgacaatttcactcgcttcagcgcgagagtgtgatagcgcatcacgccgttgatcagctaagtcactcgcttcttgccgagacttttgtgctgaatcaatgtcgttcgcaatcttgtcagctcgatcagccatcatttttgtgatgggcttccaagcaacaacagagatcaatgccatcaaaacaataaagctaatcccgataaacaacatatcaccaaggtagagaccggatgcaccgataattaaatgcgagagcatctaatgacacctccttctttcattttcattaaaatgaactcgttgaccaatgattacttgttcataaccatcaaagcaacaacgaaggaaatgataggcattgattcgatcaacccaacaccgatgaacatgttagtccgtaattgaccagataattctggttgacgggccatcccttcaagcatcttagaaataaccaaaccgttaccaataccagcacctaaagcggcaccaaacatagcaatacctgcagcaattgctcccataatctgtgtatcctccttaaaattaaaaaactagaaattattcctcgtcgttaaccttctgagaaatataaactgaagtcaaggttacgaacacgaacgcttgaatgctcccgataaacactgagaaaccttgccataagagttcaattggaaatgagtaaacatagctcaaccaaccgttgctctttgccaaatcagcaaccttcgttagtaacatttcaccagcaaagatgttcccgaacagccgaagacctaaagttaggaaatcggtaaattgttcaaagacgttaataaccgagaaaacagcaaaaggttgtgtgtattctttcaaataaccacccatacctttcttacgaacacccgcagcatgtgcaagtgcaacggtcataaacgataacgtcaaagtcacaatcggatcggcggttggactcttcagatacgtatactgcccgacctgaacgtgaatgaacaatccaagttggttagcgatgaagataaagagaaacaatgtaaatgcgtacaaaccgaagttagacgcttcgttacccttgatcgaccctttgacaatgccattcgtgaactcgatgagccactccagcacattttgtccacccttgggcttcattgttaaatgtcgcgaaagtaaaaaaacaaacaagaaaacaatcagacaagtcacaattactgagatgtcattcgcgatattaaacgtcagtccaaggaatttgactgtaggaactggatcacccactgaatatcacctctttcctttaatttcggtgctacgataaccttaacctttgagctagtcaacgtcaattttatcgtaacctgaaatggtagattagagacacccctaatcaaaatacaaaggtaataataccaccaccgtcgaaaaaattcaaaataatttcaacatttcgtcaatcaataaaaatccaacaatatcaagctttcattaagctttcaaatcgttggattttcattattttgactttattttcattcttggcacgcgcaatgacggcctacttctcatttaccgccgtctttggcagcaccaagttcatcacaattccgagcaccgttgcaactgctagaccactgaactgaaagcttcccagttgtaaataggcattgccaattccaatgaccaaaatcgctgatgcaatcattaaatttcgcttctgattaaaatcaactttattatcaatcagaattcgcatcccacttgaagcaattaccccaaacagtagaaagctgaccccaccgatgacgggtgatggaatactctcgatcaacgcggataacttacccacaaaactaaagacgatggcaaaaaaggcggccccaccgagcacataaatactgtggacccgcgtaattgccagcaccccaatattttcaccataggaggtcacgggtggtccaccgacaaagccggcgataatcgaggctgtcccgtcgccagccaatgtatggttcaaacctggatccttgaagaaattccgcttagtcaacttattgagtaccataatatggcccatatgttctgacatcgtcacaaaggcgattggtgccatactcagaatcgcgccccaataaatgccaggatgataactaataaaaggcaattgaaaggcgggcatcgcaaaccactgcgctttttccacaccagaaaagtcaacgattccaactaacacggcaatgatatacccacagacgattcccaacaatatcggtactaaactcataaatccacgcaagtacatgttaaaaatgacggtcagtaacatcgtcgccatcgcgacgccgaaatatttaatatcataactactcccgttcatcgttgcgtccttagctgccgtccctgcgagtgacaacccaattaccatcacaatcggccccacgacgatcgggggaagcgccttatcgatccagtcagaaccgattaaagtaactaataaactaactagcaggtacacacagcccaccgcgacagtcccctgagcgatggccggatatcctgcggtcttcatcagagactgcatcacaacgataaatgaaaagctcgagcccatatacgccggaatctttccgcgcgtgatgaggatatacattagcgtcccaacaccagagctaaacagcgcaatacctggatttaatcccaccaggattggcaccaataccgtggaaccaaacatcgagaacagatgttgcaccgacaagcctaaccaactacctaattttggtcggtcatgaatatctaacacgacttcatcattatgaaacgccgctttctttgtcataacgcacccctttttatgaatgattgcaaaagaaaagacagcccaccactcaaagcggctaggctgtccgaaattacgcacagcttccttgaaagcgcacgtccgttcatccttttcagcctctctgagctaatttaaaggaactgtttaattgcaatcagtctactcgtctccgaaataattgtcaactcaatgtttgaaccgaaccagtaacagcccctaaaaacgatattagttcgaaacatcataatatttataacaacattcctgaaataatgtgactttctcacccaacgttaccgaatattcgaccaatacagcgtaatcgccatctaaaacaccctaattatccagtgtcccccaacagttaatgtcaataactacctataatatacgcgttgtacaaattattatttggcattaacggtgattaaaacgtgctaattagattgttgtgcgtcagccggtgtgggtcctattccgacctccggggctgggtgacaattgctggaacgcagccgacatcgatttgagctaacgcataacccgcgtcatctcaaatacgagtcttattctaagccggaagcagaccacttccagctaagaataatttggctactgagcattgtcacccagcccctccggtcggtaagccgctcaaatggctgatgaacggccacttaacttggtacaattcgtcgctgactattttgacactggaactttaaacaaagcgttaggtgcattagcactttgtcaagagattaaattttactacaccaattcaggattagtgagctatctcaatatcattttcagtctgccggttgattgacaaaattactggttgtaaaaagcaacgacaaattcatcaaaagttaggtacatcttcgtcagccattcgaacactgtcacgactggaagtcggcttaggacgaaccagcaaagcatgtttacgcccacttacacccgtttccagtggtccatagctggctgcttttaatcttagaaattagcacgttttagtcacgattcatgactaatgaactcacagaatgcggatgattatagctagagttgttaataattttggaaaacaaaaaggtagccccccagacattgcctggcggtgctaccttttgtcaatgcaacttacttcgtaccaaataaccggtcgcccgcatcgcccaaaccaggaacgatgtagccatcttcatttaaatggtcatcaagtgctgccgtgtaaacgtcgatgtctggatgtgcgtcccgaagtgccttaacaccctcaggcgccgcaactaaacacataaacttaatattacttgcgccgcgctttttcaacatatccatcgccatgatggctgaaccaccagtggctaacattggatcaacgacaaataattgccgttgtgaaatatcacttggtaatttaacgaaatattcgaccggcttcaaggtcttttcatcccgatacatcccaacgtgcccaactttagctgccggaatcatgtttaagaaaccgtcaaccatccctaagccagcccgtaagattggtacaatggcgactttcttacctgccaacgttttttgcgttgacttggcaatcggtgtttcaatctcaatgtccttcaacggcatatcgcgtgatacttcgtacgccatcaacgttgaaatttcgttaaccatttcccggaagaccttagtaccacagttcttttcccgaatgatcgtcaatttatgttgaatgagcggatgatccaaaacctcaaacttacccatgttgctacgcacactccttagtgatttctttccattgtagctaatttagagagaaaaaaccagacctgatataaattacttaatcaacatcgatcgggtgcttcgctgttaaagccattgcttgctgtttaacgtcatctagatttgcttgatctgtcggtgcttgtaacgcttgcaaaatcaattcagcgaccttagttgcatcagcttcgtcaaaaccacgggtcgtaatcgcaggtgttcccaaccgaataccagaggtcttgaaagcccctaacgtctcattcggaatagcttctttgttgaccgtaatataaaccgtatctaacagatcttgtacttggcgaccgttcaaaccagacttagtgacatcaatcgtcattaaatgattgtccgtgccaccagaaataacccgaaccaagtcagagtcattgaagaccttcgccattgccttggcattatcaatgatatgttgggcataaaccttaaactcaggctgtaagtcttcgcccaaagcaatcgctttacccgcaattacgtgatccaacggcccaccctgattgccagggaaaacggccgagttgatcttcttgccatacttttctttcgctaaaatcataccgccacggggcccccgtaacgttttgtgcgtcgttgtcgtaaccacatcagcatatggcaccggattaggatgtagcccggccgcaactaagccggcaatatgagccatatcaaccatcaataaggccccaacttgatccgcaatctcgcgaaacttcttgaaatcaatcaatcgactataagcagaagcccccgcaacgattaactttggttgaaaatcttgtgcttgtgcaagaattgcatcgtagtttaattcttcagtttcaggatcgagcccataaccttgaaaatcgtaaagtttaccagagaagttcacactagatccatgtgttaagtgtcccccagcatctagtgacatccccatcacccggtcaccaggttgaatcagtgccatatatgcagccgcattggcttgggaaccagagtgtggttgcacattagcatattccgcaccaaataatttcttagcccgttcaatggctaaggtttccacttggtcaatgtattcgttaccaccgtaaaagcggtgacccggatagccttcagagtatttattggtcagcacactcccctgcgctgcccggacgccctttgaaacgatgttctcagaagcaatcaactcaatattatgttgttgccgtgcctgttccttactaatcgcagcccatacttctggatcttgttcctggtaattcatgaataaatctcctccatttcgcaagtgacaactttcgggttttcccgacttgcaatcattatacactaaaatgagtctgaccggcagatttatttaatcggttcatgtaggcaagcccaagtcctttattttcaaaggcttggcacagaatatctttaatttccgtctcagtatcaaagtgccgcaagcccgcgaacagctcccgacttgccgattgaatatcttctccaagcgaaaattgttcgcaattagccggaatttgattgttagttaaaatatcatctgttgccataacgcccattggcacatcttgctgggctgcccacgccagcgcttctggccaatcttccgaacgatcaacgatataaacttgtgcgtttggcgcatagtgcttatatttcatccccggcgccttaggaacttccttagctccgacatggtgcaattcggtttgaactggcatgccaatgacccgttcgattgcttcaggcgttacggcaccgggccgtagaattgctggttggtcggttgaaagatccagaactgtagattcaacgccaaccttcgtcggaccatcatccagaataccagcaattttaccacgtagatcatgcaatacgtgttgcgccgtcgtcggacttggcttaccagatgtattagcggatggtcccacgataggcgttccggccgcacgaatcaaagccagggttgcctcattatcaggattacggaaagccgccgtctgcagcccaccagtaacttctggtgccaacgcatctggtttcaatttaaaaatcatcgtcagggggcctggccaaaacgccttaatcagcttcttggctgcttccgataacggttgagcaaaccgctcaacggtttccacatcagcaacatgcacgatcaaaggattatcactcgggcggcctttagctaagtacacttgcttaacagcatccacatttgtcgcatcggcacctagcccatagaccgtctccgttgggaatgccactaactgccccgcagttaacaacgccgcagcggccggaatctccgccggcgtatatactttcgtttccataatatattcaaacctctactttattattaattcatcgttactttcatataatattatttattatttacatcacggacttaatcaattgctcataaattcacgccgtacctcccaggttaaaaacagcccgcttaggataagactcacatttgagataacgcgggttatgcgcgagctcaaatcgacgactgcgttcacccacccccgaaggccggaatgggacgcggattacaaacagcaatctacctaatcggcccgcttttatcagcattctccaggataacgcgcaactattgccgagtcagagtcattgcaactcgcagcatccgatcgtgacccgccatgtcttgtcgcagcgtcacggtcgcgtcgggcatcgactgcgcgaaaagcgtctgcaaggccggtccctgatggtagccgaattccaagtataagcgaccggtcgaagtcagatgatcggcaaccgtcgtcgctaactgctcgtaaagtgccaacccatcgtggtcagcaaataaggccgtttgtggctcgtgggcgaggacgctggcgtccatgacgtctttttcgctcgcagcgatgtatggcggattactgacaataatatcaaacggctgcgcagatacgctggtcaatagatcactgtgaaccagcttaacatctaaatgtaggcggtccgcattggctttggcaacttgcagcgcagcggttgaaatgtcgctggccgtaatctcccatgccggccgttcgtgtttgattgccaatgcaatggcgcccgagccggtaccaacgtctaagagtcgaactggcgctgtcgctgggacatccgtcaaaatccagtctaccaattcttctgtttcgactctaggaataagcactgctggatcaacttgtaacgtgagtccataaaacggtgcgtctccgagtacgtactgcactggctcaccagcaacaacccggtcaatcccctgctgataagcatgccaaacagcactgggtagcggctcgcggtaacgaatgagtaattgtgtctggtctagccgactcaagcccaataacaggaagcgagcactatcagtcggcaactgggccgttcttagacaaaaagaagcccactgctgggcttcaaaataagtgggttgagtgggcttattcattagttaagcgctccattttttcagcttgatcagctaaaacgagggcatcaataacttcgtctaactcgccgttcatcacccggtcaagtttgttgagcgttaacccaattcgatgatccgtcacccgattttgtggaaaattgtaagtccgaatacgttcagaacggtcacccgtcccaacggctgatttacgttcagcatcatattcgttttgttcccgtgactgatagtagtcgtagacccgtgcccgcaagatttccatcgctttggcccggttttgctgttgcgaacgttggtcttgcatcgagaccacgataccggttggtaagtgggtcatccgcaccgctgaagacgtcttgttgatatgctgaccaccagcaccagatgaacgaaagacatcggtccgaatatctttttgatcaatatcaatgtcaacatcctgcgcttccggcataacgccgactgttgcagttgaggtatgaacccgcccagccgattcagtcactggcacccgctgtacccggtgcgcgccactctcatacttcagcttagagtagactttgtcaccagaaatgatcaaaacgatttctttaaagccaccaacttcagtttcattacgatcagccacttctacttgccagccttgacgttctgcgtacttcgagtacatgttgaacagatccgcagcaaacaaactagcttcgtcaccaccagcagcaccgtgaatttccatgatgatgttcttgtcatcgttagggtctttaggcaacatcaataacgtgatttcatgttccaattgatccttttccgcgttaaggttctttaaatcatctttgaccatcgcgttcatctcatcgtcgagcttttcatgaagcaattcgtcattttcttcgatctgactcgtgacttccttgtagtgattatatttttcaaccgtttcacgaatattacccatttccttagataacttcatgaaacgttgagaatccgaaataacttccggatcacttaatagttcaccgagttcctcataccgatcggcaacggcttgtaacttatcaaaaaacttatccattctcagttaatcctcactttgttaatttcggcgggtaaaaataatgatgacgacaaactgggtagtacgcctcattacccccgatttgaacttgttcgccttcataaacgggctgaccatcgtggaaccgtaaattcataattgcttttttacgacagaaccagcagatcgtcttcatttcttcgatcttgtccgcatatagcagtaggtacttgctaccttcgaacaattcgttacgaaaatcattctttaaaccaaacgtcatcactggaatctttagctcatcaacaatgtcagccaattctaggacgtgatgctttttcaaaaattgggcttcgtcgattaaaacgcacgcagcatccggattcgtttgtttaacgatctcaaaaatattggtatcatcaaatactggcgttgcttcacgtttaaggccaatgcgactcgcaacatagcccacaccatcacgattatctaagccactcgttaagataatgaccgacttatcttgttcctcatagttatgggcaactttcaaaatttcaatggttttaccactgttcatcgcgccatatcgaaaaaataactgtgccaagcgactcattccccttttttacacatttctagtcaattatagcggatttggccgtgaatttcagcattctgtcattaaaactaattaacgaattgataatatgcggttaaatggcgggagtatcacttttcttttagggacgttcagtataaaatacttgagagtaggacattttgtccggtaattatgattttaatacccggtagttggtcacactgatcatttcccaggtaaatcaagaattaggggtaccgataacttatgtcaattaatagtacattagccacctggacgggtaaatccgcatattggtttttacacaccttccgtggcggtgggagctcactccccggcaagttagcgctgaagctcgatccaacgattttaaagcatctcgctaaaaactacgacgtcatcgtcatcactgggaccaacggtaaaacgttaacgaccgccttgacggtcaaggttttacgtgaacagtaccctgacattttaaccaatccaagtggatccaacatgaagcaaggtatcgtcacgacctttttacgggcacctaaagcgcaccaaaagccactcgcagttctagaagtcgacgaagctaacgtaatcatggtcaccaagtacatcacgccaaaagcctttgtcttcacgaacattttccgtgaccagatggatcgatatggtgaaatctacacgacatatcaaaaaatcttagacggggttgctttagcacctgaagcgacaattattgccaacggtgatttgccactcttcaatgccaaacaattgcctaatccgatactgtattacggatttgactaccagcccgaccatgaccaacaagcgccagcaaatacggatggcctgctttgtccgcgttgtcagcatattttacgttaccatagtcgaacttatagcaatatgggcaagtattattgtccccactgcggttttgagcgtccacagttgacatacaaattaaacgccctaaccgctatgacaccgactagctcagactttgaaatcaacggtcaggccatgcatcttaatatcggtggtcaatacaatatttataatgcgctagctgcctacgcggttgggcgcttcatggacgtcacgccggccaaaatcgcgcacgcccttagcgacaacgatgaacaagtctttggtcgtcaagagacctttcacgttggcgaaaaggacgtcacgctgattctcgtcaagaatccagtgggccttaaccaagtcttgcaaacaatcagcaccgatgaccggccattctcatttgccgctctgctcaacgcaaactatgcagatggtattgatactagttggatctgggatggtaattttgaaaaattaccggcattgaatattcccgcctatattagtggcggtgaacgttatcgtgatatcacgttccggctaaaagttgctggggtaccggaagatcagttaaccattattcctgacctgaccaacatgacgaccgcaattcaaaaactaccgaccaagcaagtctacgtcgtcgcaacttacaccgcgatgttgcaattacgaaaacaacttgctagtcaaggcattatcgatggggggatggcttaaccatgacttatacactacacgccgcacacctctacggcgatctaatgaacacgtatggtgatatcggtaacattttagcaatgcgctactatgctaaagcagtggatgccgacatcactgttgacttagttagcttggatgatcggtttgacgaagaaaaatatgacttcgccctcttcggcggtggtcaggattacgagcaaacgattgtttccaaggatttacaaacgaaaaaagacgctttgaccgcatatatcgaagccggtggcccattattagcaatctgtggtggctttcaaatgctgggccattactacattggggcccatggtgaaaagatcgcgggtatcggtgccttagatcattacacgctcagtcaggataacaatcgctttattggtaatataaccattgagaacgccgaaacctaccagacctactatggttttgaaaaccacaacgggatgaccttcctgggcgaaggtgaacggccccttggtcaagtgctccaaggtaacggcaataatggcaaagatcaatctgagggcgttatctacaagaacacctttgggtcttacttccatggtccaatccttgcacgcaatgaagccctcgctaaacgaatcttgaaactggccttacaacgtaagtaccctgaaggcaacttcgatgcactggatcaactcaacgaagacctcactaaaaacgttatcgtgaaaccttaaaacgtatcactcaaaatcgccactgacttagttaccagccagtgacgattttttagtttgatccgtattaattggttacaatgataatagtttttggaagccttctcattagtaaaccccttcaagctataataaatatttatatactttcagatagtgattattaataaactgatactatcagtagatacacaaaaaaagattgatattggcttccaaccagtatcaatcttttttatcccatcaaggggttaactaattatgccttagccccaggttctgaagcaataacttgtaaatcgcctttcaatgtccattgttttacgtcaaatggcaagataaagtggacgcccttactcaatggatagtcttgaccgtcaacgacaatgctaccttcaccatcaagtacagagactaacgtataaggtgctgttccccggttaaaagttgcttgcccatttgttagccgccattgccaaacaccaaagaatggtgattggacgtatttggtcaccgttgcatccccaacctgggtagtcgtgatgtcaagatcagggtcatgatgcggaacgttagttgtatcaatggattgttgcaaatgcagctcgcgcttctgaccagtggtcttgtcgacccggtcccaatcatatagccggtaagtcgtatcagaactctgctgcgtttctaacaccataattcccttaccaaccgcgtgaatcgttccagatgggacataaaggaaatcgccgggcttaacgggcactcgccgtaatagcttattccattcaccgttgttgatccattcagcgagctgttcacgggtcttcgcatgatgaccataaatcatcgttgcacccggttcagccgcaatcacgtaccagcattcagtcttgccaagttcgtgctcgtgttcagccgcgtacgcatcatcaggatgcacttgcaccgacaaatcttcactagcatccaagattttcgttaatagtgggaagacatctcccttagcatcaccgaacacatcacgatgttctgcccatacccgatccagtgtcatgccagcgtacggcccattttcaacggtcgccggaccatgcggatgagctgaaatagcccaacattcaccagtatgatcactgggaatatcataattaaaatcatcatgtaatttggtaccgccccaaattttttcatggaacaccggctttaaaaagtatggctcactcataagatctactcactccattgttgaatttaatatctaaattttagcataaatgaaagcggttgtgaaaccgaagtagctaatttgtaaccgtatccgccaaccaagccgcaattaaccggcgacgtgctggaaggaataccgaattatttgcaactggatgcacccggttggataagaaaacaaggccccgttgccgttgacggtcaagcatcaggagcgtaccagtataaccagtatgaaaaatcaccggcagtgtctcatcagaacggtgccagaggttccaaccaaagctccggcgtaagtgttgattgggcgtccaatcttgatacaagcttgcaatcgtagcctgtgatagcacagctggtacgtcgatttggccgagcatcagttgtgaaaaccgaacaaggtctgtcacactggcaaataaaccggcggaaccacagtgttcacctaagactctggccttaggatcatgaacgatcccccgtaacaacccagttttcatggaatacgccgtcggaacggtttgcgctagttgaggttgaaaactcgtgtgtgctaaccctaatggctgcaagacgcgctcagtgataattggctgaatggccgctccaagaattcgttcaatgacttgccccatgatgatcaagcctaaatccgtataaaccacccgatgattgcggttacgctcactgattggtagctgttgaatcgcggctaataacgcatccgctgacaacacattccgatttggaatataaccactcagcccacttgtatgggtcattaaattacgaaccgtgatcgttgtggactgtaaagtcggtaggtagtcatgcacggggcggtcaatttcaagttgcccattttgcatcaactgcatcgccacggttgtcgttcccacgaccttagtaaccgaggccaaatcatacatcgcatccggccataatggtttgattgttggttttatttgagcgacgcccacttgattcgtgtgccactcagccccatcaatcaaggcataactcgcccctgggatcacttgatcttggaccatttggttaattagtgctgcggttctactaaaagttaacattaatttattcattctctcttattaggatcatgattcaagtcgggattgactgtggctaaaccgccttcaaggtcagtatcaaccaagtaacctggcaaactgtccacgttttaccctgacaatttctacggatacgaactgacctgattgcatcaacgaccttcccgaagctagtgctgacttccgaacaaccgcggtaatgtgaccaaccaataactgattaaagcggccccgccaatgacgagaagccattgattcgagacaacctgatgattatacagtaacgtacagcccaccaaaattcccgtgctgacccattcaactgcctgccaatgtcgattactccactttatcatcttgcccaactccctttaattttagcgtttcttcagcaactttacatcacaatcagcaatcttaacctaaccgtaacgtccccttagccgaataactgtcgtttcgatcatgcgtctactgattagacagcattcctactattcacaataccacgtacatcatgcgcacgcacataaaaacgactttagttccacccgtatcacgggtcttactaaagccgtctttttactcacacaaacaacactgtgcttagtctaattcaactttctggacccaaccttcaggcgcttcccgatcgccaaattgaattccagttaattcatcatataattttttcgttaccggaccaacttccgtttcactgtagaacacgtgtaacttgccttgatgttccaagccaccgattggtgaaataaccgcagctgtcccacaagccccagcttcagcaaaccggtctaaatcatcaatgtagacgtcgccttgttcagtcttcatcccaaatttatgttctgccaagtagagtaatgaatatttcgtaacggaaggtagaattgatggtgacttgggtgtcacaaaagtgccatccttagtaatcccgaagaagttcgctgaacctacttcttcaatcttacgatgttcaacaggatcaagataaacacagtcggagaaaccgttggcatgggcttcttgacctgggaataagctagccgcataattcccaccaactttataagccccggttcctttatgggccgcacgatcatattcggacgtcgtaaagttggttggcgtcatcccgcctttgaaataactaccaactggcattgcaaagaccgtgaagatgtattcctgagctggatgaacaccaatgttacccccaaccccgatcatcaatggccgtaagtataaagtcgcaccagtcccatacggtggcacgtaatcttgattagccttaacaacctgtttaacagcgtccacaaacatgtctgtcggcacttgtggcattaataaccgttcacagctggtctgcattcgggctgcattacgatctggccggaataattgaacactaccatctttagtgcggtaagcttttaatccttcaaagtcttgttgaccatagtgtaatgctgttgagccttcactaatatgtaaagttgcatctcccgttaattcttttttgtaccaagcaccatctttccaatacgcacgataacggtacggaagattccgatattcaaaccccaagttgttccagtctaattgtacgtctgccatatgcttcgacttcctttatatgtaattttccaaattaattaatttgaatttaattaaaagattaatggttaattagaagtttgtcaagggcccgttaaacatttccaacgctttaagatttttttggtataatgagtgtaaatttagcaaaggactggtttgtcgtggctagtaattcagattcaatttataacgtcatgttctatatcacccatcacccgactgaaattcagtttacccaaccggaatacacgaatgtcgttcggatgggtgtccccgatcatattaaggtcgctaaccccgaaatttattttcctgacaacaagctattagtcaaccgatttcaggatgactttgtcgctaaaaacggcaacttacttgatttcttcttcgattacacagagaaaaaagtccctaactaccatgaagtgtgggtttcttcggcccatttaccagccaaacacttatacttcttagagttatcatttgagtaatttaacgcacgtaacctttacggtctatttggaatcaaatttaaaatggatcaatcaaaaaatcaccacctggattatgttcatccaggtggtgattttttgattactttacaagcgtaaaatgcagccgacttagaactacgggttcgtcccgtcataacctcgaatagtgagctttacttgactaatcaaagtccagtcgcgctcataaaacattacttagtcataaagatatacaagtcagacgtggagacaccaatcgtgaagcgaacgcccttagaggtaatcggatcgattgtcgtcgtactaccactattatccttggtttccttctggaactgtttcataaccttcttggcattggcgcccgttgttgtcgtcatcaaagcaaacgccgtcccaaagttcttctggcgggtcttgttcttaaaggccttggttggaacaatcatcgctgcccctaatacgtcacccttctgaacatttagccggatcttataatcctcagttgttaacacgttcttgatgccatcacttgccgtcttcgtcggtaacaattgcgacttgacctgctttttcgccgttgccattgccgcttcgacctgcttctgagtcgtttgcaaactagctgctttggtcttgagctgcgccgcagcagtttgttgggcttggagtgtcttagcacccgtggcagccgccgtaccgccagccttgatctgagcctgggcttgcttgactttggcttggatcgttgcttgttgctttttaagggctgcaccctcagtttgcaacttcttagccgcctgttgatcagacttgctgagtttagaagcaatcaaagcttgattgtaagtcgtcgccatcttttgatagccaactagcttcttggcgccctttacgtgcaccgtcgtggtatccgaaccggccttaatcttcaccgtttggcgggtcgtcttggtcggaacttgaataacaaacgtatgattacgcaccgtcgccgtcttcgtctgaccaccgtcaagctgataatgaacctttttaacgttggattttcctttgacggccgctactaacccgttcggcttgtatgtggttttagtcgttgataaggttgtcttaccacagcccgctaataagaacgttagcgcacccgcagtaacggcaaccattgctgttttccggaacaattgacacccctcctttagtcgagactaatattgccagtaaattgactgttatatagatccgcatagaacccattttgagccatcaactgttcatgcgtcccagtttcaaccactgacccatggttcatcacaataatgttgtccgcaccctgaatcgttgataaccggtgcgcaaccacaaaactggtccggttcttcaggagtcgttccatggcatgctgaatatgcacttcagtccgcgtatcaaccgaactcgttgcttcatccaaaatcagaatttctggattagccacaaacgcccgggcaatcgtcaataattggctttgtccctgtgaaatatttgaagcttcttcgttcagaaccgtctgataaccatctggcaatttgcgaacaaagctatcaacatgggccgctttagccgcagcataaatctcttcatctgacgcatcttcacggccgtacttcaagttgtcaaaaatcgtcccagtaaagagccaggtatcttgaagcaccatcgcaaagtgtgaccgcaagtcttcacgatccaggtcccgtgtatcggtccctttcaatttaatagaaccacctttgatgtcataaaaacgttccaacaaattaatgatggtcgtcttaccagcaccagttggcccaacgatggccacttgttgcccacgtttaacgtccagattataatccttcattaacaggtcgttatccgcataaccaaattgaacgtgttgcagactaatcaagtcatcactatctggttcggctggtaagttggatttcgtctgtttcatttcttcttcatcaagcacttcaaagacccgttcagcggaagccacggtcgattgaatcgtgttcaacaagttcgccatttgtgaaatcggttgtgaaaattgttgcgtgtattgtaagaacgcttgaatgttacctaacgaaacgttcccgttagccacatcaatcccaccaatgatggcaacaaagacgtagccaatattatttaagaacatcatcagtggcatgataatacctgaaataaattgcgctttccaggctgattgataataattattgttttggatttcaaaatcatcgatggcatcttgttccttgttaaagctcttgatgaccacgtgtccagcatagttttcttcaacttggttattcaacaaccccaagctcttttgctgtgttccgaagaatttctgtgatttcggcgcaatcacaccaaccaccacgacactcagtggaatggtaacgagtgcaatcaaggtcagcttccaactaatcgtcagcatcatccataaggttccaacaaaggtgacggtacttgtcaccgcttgggttaggttttgctgcaacgtgttggcaatattatccatatcattgacggcccgactcataatgtccccattcgaatgggtatcataatatgaaatcggcaccttttgcatcttacccttaaatgaacgccgcaacttatacacggtccgttgggaaatccgcgtcataatgtactgttgaataaagttgaacagtgctgaggccaagtacatgatcaaaacgatcataataatctgaccgattttttcaaagttgattgggtaaccggattgactgataccagccttctgttgcgcggcccccttcataattcccttataaagttcggtcgttgctttacctaaaatcttaggtgttcgaatctggaaaatcacggaagcaatggcaaaaatcatgaccactgccaaaccgacccaccggtctgacatgtagcgcatcaatcgaatcgccgttttccaaaaactcttaggcttttcaactagtccagcatgaccaccggggccatgaccgccagcaggacgtgcaggcttagtagaactcgtattcttttcgctcattacagctgatcctcctctcgtaattgtgacttcataatttcttgataaacttcattattagctttcaattcagcgtgggtccccttgccgactaacttaccgttatctaggaccaagatcagatcagcatccgccaccgtcgcaatccgttgcgccacgatgactacgacactctgttgaatctgtttatcctggcgtaattcagcccgtaattgagcatcagtcttgaagtccaatgcggagaaagaatcatcaaatacataagcggaagcctgtttgacaagtgcacgagcaattgctaatcgttgccgttgaccaccagagaagttacccccaccttgttcaacgtgtgcatccaggccgccttcttctttaacgaagtcagttgaacgagcaatttctaacgcatgccagatttcatcatcggtcgcgtgttcgttaccgaattgcatattttcacgaatcgtccccgtgaataaagtagcagtttgcggaacaaacgaaacggcttgatgtaaatcagctaacttcaactgccgaacatctttcccatctaatttgaccgccccactctcaatatcatagaatcgggggattaaattaacgagcgtggtcttcccagaaccggtcccaccaataatggcaacggtctgtccagaatgggctttaaagtcaatatctgccagcgctaattgctccgcactttgatatcgatagttgacatgatcaaattctaagctgtgttcagtcgtcgctggtaacgttgctgccttgtcagggtcagtaattttaggttcaatacttaagacttcttgaatccgggaagcggaagcggccgcccgtggaatgaacgcaaataccatggcaagcatcatgaaactcatcaatacttgcatggcataagtcataaacgcaatcatattcccaacttgcattgtttgactactaatcaattggccaccaaaccagacaattgccacattagtcccactcataatcaaagtcattaccgggtaagccaaggccacaatcgtattaaccttaatcgcattgtgcgtgtaatcttggttagcgtcttcaaaacggtcctgttcaaatttatcttgacggaatgcccgaataacgcgtactcccgttaagccttcacgaaaaacaaggttgatgcggtcagtcttagtttgcatcgcccgaaacaacggtattgcaaatgccatgatcaaaccaataaaaatcaatagtaccggaatagaaaccacgaagatccaagttaattcatgactcttggtatacgctaaaaagcttgcaccaatcagcatgattggtgccataatcatcattcgtaacgccatcatggccacgttttgaatctggacgacgtcattggtcgttcgagtgattagtgaagacgtctcaactttatcaaattcatcatttgaaaaattgatgacctttttataaatatccgaccgtaaattcttccctaattgttgtgatgaccgcgccgccaaaaagacgttgacaaacgctgcgacgactgataacaatgaaaaaccaatcatttcaaatccgattttccagatataactaatgtcaccagtagccaccccgttattcacaatattagatgtcaaactaggcagatttaaggtcgcaatcacttgcacgatcataaataagaccgcaccgattaccgcgggatacgaaatccgaccctttgctattttaagcatttgcacgctccccttcattcattcattattacataataatgcagtatcttaatctaactaaaaagggtccttttgtcaaccatctttacaagtctcacgtaaaatattgtaacgcactcatcgcagtttagcactcaaaaggatttaagaatttattaagctcgccttcgtaataacacaaaaaaaagtgctgcgtcactaatcgctgacacggcactatgcctaaatttaagccaatacttcttgtatattttgaggtacctgatttgtcgcaacggcctcccatgaattcacgttttgtcccttcgtctcaatctttaaatagtgtcgttgctttagccggtgatctgcggtaaatgtcaaccagcgttgcttaccttgcgcatcgctggtcagcattcgataggtatagatatcttcgcccatctgaccagtcgagtggccgattgcctgattagtccgaccatagaccgtttgtaccttaacaaatgggtttaagttatccaccgccattgccagctcactcccctgattcttcgtcatcgtcggtacaattaacaatgtacctacactaatcatcataataatcgccgccaaccaaatagccctttttttattcataaatactatcccccgaattaattattttattaatcgtatcggagtaaagctcctctggctaccctaactaggctttcttaatcagtttaaacgattactaatcaaattcgattttccttaaacattaaggaaattattttaacaataattcaataattatcgcgctttgcatgctattctattagaataggaagtagtttttaaatcatggggggatttatcatgcacatgcggggtatcaactttgtattaggtctcggcgtcgcgctcggcctgttagcaggctgtcaggcggcttcaccggcaactaaacaagccagcagtcaatcatctaagactagcgctaaaagcgttcacagctcggctaaacaccaagcacaagcacggccttatcaacattggcataccgtcaaagatgttcacttgcctattttgatgtatcacagtatttctagcgggaaccagttacgtgtccccgccaaagaatttcaaactgaaatgacttatctaaaggcacacggctaccgaacgctgactgccaatgaagccgtatacgcgctcaaacatcggcgaattccacaaaagaagattgtctggatcacactcgacgatagctataaagataacatgacagcagcttggccaattttgaaacagacgcaccaacacgccaccattaattttattaccggctttacccataagaaaaaccacttaactttagctgatgctaagcggatgcaagcatccggtaatatcgattttcaaagtcacaccgttcgccatctggatttaaataatttaacttaccaggttcaacttacggaattatcaagttccaaaaaatggctcgatcataatttacaacagaacacacaagttatttgttacccagccggccgtgctaatcagcagaccattaaagccgataaacaggctggctatcagtatgccctatcaacggcacctggcatcgccaccagcacacagaacccatacaatctcactcgacaacgggtcgtacctggaatgtcgctaacggcctttcagacactattaacgagtaataattaattcataggacccttacttgtgacacgatcccaaaacccttttttatgagcgcttaacagtgctgttgtgatcacaacagccaaaacgcaaaattggggttttgatttgataccaattagcaaaagagaagcgtcataatgctgatataccagcattatgacgcttctctttttatctaccgacgtcgacttatcacccgcacggtagttataccatcataggtagaacgtaacaagccattggtattaagccctttgcgaaaaagagagatattttatttacaaatcgtggaagagcacaaattaatttaatattggtcctttttttgatgttttgctttctccactattatatactaacttattatcttaaacacaaaaaagtcccacaccagccaattaaggctagtgcgggacttttttgtgttgtctaaaattacaactttcgtagttaaaaattaatttttgctgttgcaccagcattctctcatcattacaacacttatacaatgaaagcataaatttcacaacaaacaaaaaatcctcacaccagcaattgccagtgtgaggatttcgtctatttgataagtagcttgttaccaggataaatcgttgaatagatactcttacctttttgtgctgccaatgtagtcatgctcaggccgttgcgttgtgcaattgcccaccatgaatcaccgtacttgactgtataatacgtgtgagaataaccagctttagaataccacctgccaattgccagtaatgtagtttcacagtagtgagtattaaagttgcacgttttctcatgtattcctatgataataacggaacctagtaataatatggtttcctctttcgctaagatactttctcatatgtattagccgtctgcctttacagcaggcggctttttacacaaaaaatcccccacgccgaagcgcaggggattaattatactattttgctgcttgtgaggacgtttcggcatctgattgcgaattactattcaaattatccgctagtgatgacgctaaagtggctgctgaactagccgtgaccgtgtcaccaactgccgccgcgctagccgcttgactataagccgccactaccgcctgtgacgcttgggcttcggcttgactagccgctgctgagttagctgcttcaatcttagcttgagcttctgccaaggcttccacgaccgtttgttccgtagaagctaacgtgctcgacttggtcttgatcgtgttgccggtatcttccaaaatagaattatctgtgattacaccaacaaaggccaggattgccccaactgcagtaatcaccaaaacaactgcattagtgtcaattttaacaccaaagaagaccgttaatactgctaaaccaataatcaacacagatccaataatctgagcccagtaagtgggcttcttgtaattagctttaaatgttgccataatcttttccatatctatcggcttcctttcacttatctttcttatagtcatttttgaacaaggtatgaatatcctcctcatggcggattaacatccgctcatgttcctgtagcatttcagtgtgttgttgcagcagacgctcatttgaatcgctttgctgttgattagcaatccccatatctttgatttggtgagctagttcttgcatttgataatttagcggcgcaatgagaaccacacgaaaaatccatgataaggcaccgataaatatcgccagaatcgacaagagggacaaccactcggctatgctatacccaaaaacatagtgaggcggttgctgaacgacgtgtgtggcccccatcaccaacattgtaaatattgacaactatctcaccaccaatctctgaccaggatagatagtggtgtaaattgactttccattctggctagctaatgtagtcatgctcaggccgttgcgttgtgcgattgtccaccagctgtcgccagacttgactgtgtaatacgtgtgagttgcaccactctttacatattccagcgtattacttgccggaccggttgctaaatagccataaccattaaatcgtggctgacgtacccagcgatacccgccctgaataatggcttgatcagtctttaccgtggttccagctggcaaaatagtgatcgtgtttgatgacgttgacgtgcttgtgtgcagcttaaccgcagtattgagtgtgtaagttttagtttccttgatccacttggatgacgcagatttcttgtaagcatgtttgttggcctttttgttgttgaccttaactgcacctttgttagttggcttgactgttgatttttgaccagcggtgtagtagttgtcatttaattggctaacatcgaagccaccatagctaatacggaacttagccgttggtgaccactgccatgcgtggttatttgaataccagttcttaccgctaaccacatacgggtaggcagcaatccaaccggttttacttttgacagtcatcttattgttggcccatgaccctgacgtataaatatcagttcggtaaccaaacttttcgatttcttgcataaacgctttgttattggcgtcgtttgtggctttggactggttattttgttcctcagcttcgacgtcggttgctagtaccgcgcctaccggtagtcctgccgctttagccgtttgaccagcaaaatcagcttcggcaatcgcttgtgccttagtggcgtatcgtgcaaagtggtaaccattgatatataaaccagcggcctgaacattggcaatgttgcttgcagcatagggatccttatacgtaccaccttcactaatcttgaccgtgacagccttaacaccaaactcgttacgcatggaaacgtactcagcagtactcatgtagccgttgttattcgacacatcgaccatatccatgcgagcagcgttactggtaacgttgaccattaaaaaggccataaaaatggcgcccgccgttaagatgggtgcctttagcttgtacttattcaattgtctacctcccgattacgataccttaaaattctaaatactgttctattttttctgcgattagctgcataccaagatcacttgggtgtgcagcttcacccgtacttgtgatctgccatgatgtgccatcagttccagtgcgggttgccccaagcgtactacgcgcacctgattgattagcaattgatgtaatatcaacaaaagttgcattctgtgtggaacatgctgttttgacttcagcaagcaatgtatcgtcgccaaaccaacgcgctacccacaatatacgcgcttttggcgatgtggtatgaatatttgaaagcaatgattgtgcatctgtcgcaaaagttgcttttttatcatccgtgttaacattgtctactaactggatgattactagatcagtgtcactatctaaagaaggtttaattaaagattcaaatgccgcttgacgcgcatcagaggttgtcgctgattcccaaccagatacatttgttcggtcgttaataacaacatttttattctttgatttaatgtattcagttataatatggtaccaatcatgattgctatcagaggctgccatacctattccaccctgttctttgatcaaagaatttccaaaaattgctactttatttggtgtttggctcacaactgacaaagtaccattttcatcgacaaaaagtcgatacgtttttccgttagcatcttttacatatagattatttcccggttgatttacttttgataatttggtatttattgtttcaacgttttgattaatatcgacaatttgatttgtaaggggcttctccataacttcatatgaaaatggtaaagttccggtgaacggatacataatcataccagtataaccaacgacgtcagacatgtgtgtttcatcttgaataagtgcgtcagacattgatggtgtgcttgatgtaggatataaacctcctaatcctgataagtccatcattagataagatcctttttctaaataaatggctttatctcgacaattaacgatgttatacccagcacttaacggcactgtaaattctttgcctgcaacaattaactgatgttgatcaatcatagccgtttgaaaagtgtaagtgcctgccgttggaacactaactgaaatactgtctaactgtgcattatcaattgatactgcactgttaggggtaccaaaatggattttatctattttgtttactggctcattggatatgtcagtcaacatcggatttccaattctttcaattttcctgtcaccgagttgcgaaaaaatttcattgtcaaaatattgctgattaccaactaatgcagtgttggacatgctgaggttacgtaatctaaaacacgcattatttttatgaactacaaatagcagatagcaattagtagtaacgcctaattcattgaaaaattgtggttctaacgtgtagttaaatcttttcatagatgtattgtctgcagcttcaagccctttagctgtgttgatttcatttttatcgtttaatacataaaattcgattatactgccaacaacgcttatgtcaaaattaacataaacaggcttacttgcatcaattttaatcggaattaaacaccctgagtcaccgtctgaattttgtacaaaaattaattcatcggaatcatatgatatgattccaccgctaccccacaccgatgccatcttggttaagttaccctggccgacttttgccggactgacagaaaagtcgtttataccatcactattgtcgtttgccaattgatctaattgtgcgaatggtgatattttacgatcagtccaattaagtaagggatcaattacctcaagtgtgccagagccatgcactacaaatagtattttgaatttttcgtccaaattgaaattaataaaaaattgaccgttaattgaataacgtgcgtgcttaacaatcgatgtgtaatcagttgatattagacctggctttcgtatatcaccatccttattcattaggtatacttcaaaagctccagtcatgtttgtaatatcaggcatacggtaatcaaggttaaggtatatattttcgtctttggttgggattctgttcagatgcgcctgcagcacaataccatggtcaccaccattacttgtttctgttattgttcttccagctctgttaatagtacctgcaccattccaacttgtagctgaattaattgacaaataagaatcatgaacatcattaagatttacttcgttaattttttcaatacctaaactgtcatcttcgatcttatctgcagtaatagatccatctgcaatgccagctgattgataaattccgccatccttccaagcactaccattccagtagtaccagtgccctgtatccgcggttacaaaaatgccaacctctccatctggatattgtgttttaagctcatcaaaagttgacagtgttccacttggggcaaaagttgctttcttagcagcgttaatgtcgtataaactattaagattagcaaatgcttgattaccgctcgtccagtttttgttaagatgatccctaaaatctcttccttgtaaagtagtcccttctatttcgaaaactcccattattttgtctcctttttatatatacatgtagttagcatcaacgtttctttttagccaattattggaaaattgccaaatgttagctccagctggtttgctgctagcatcccaactagcaatccacctgtatcgagctgctgagtcaaaccaagtgccaaaatgactagcactagcgtaatcacaagtgactgtatatcctgcattattcaacactttataaaatgttgctatctgagtgtttagctcgtctttagtaaaacttgcgccaggttttgttggatctattgatgtattttcaatatcacacgctacaatagccgtagtaggcacattgttagctttcaattgtgctaaaaaatattgcccctctgcgataccgttacccataaaatagtgataacagccgactaaatctagcccagctgattttccgttagcaatctgtgtagctgctagtgggttaatgtaatcagtcgactgagttagttttacaattagtctcttagctccgttagctactagcgaagcaaaccaatcagtagaactattaacattattagatgaaacatcaattacaataccattagattgcagcaaattaatctggtcttgtaagcctgatatagagctgctttgtttgctataatcagctttaaactgctgatagtactgattcaatgttatcaagtcttgttttaactctttaccgagtttaatgttactttcatatgccttacgcgttgcagtttcccacacaactgggtcgaacaacttattgccaaacgttatagtttcatccgatcgcctttcttgcgggtatttagtcatgctgtttattcgcacctcgacatccacaccaaagcgatcacgcaaccagccactattaccaaccgcaatatcgttaggattaaatccatagatttgctttttaaagtccacatattccatcgtgtactgaatatctggataatcagtaatagcagcctttaatttagccagcaaagtattcttatcggtaatgttatcatactgttgtggctgtgcatcaatcgtcccccacacgtcagcattggggcttgtgtactcagcggtaacaactggtttgttattattatcaagcttaccctcgccagtaatatgggttgttacgttttcatagttgttattctcagaaatcttggagcaattcacattgtcaacgaacacaaatgcattagacttaccaatttttttgcaatatgaatgacataattgtcgaaataatattcgaaaccaaaatctccagctaagttttgcatgagcaattcatcagcaaagcctttgccaaagttcttactgaatgcgtaattagcgaatgaaccgtcaatcacatacgtaaactgtgtattttttatgattagatccatacatgttttaagtgattgagtgcccgttaacaccgacccaacataatgatcatgtagttttttgctaacatgaatggctgagacagtatagttacgcatattacccacagatgctggattagatgttagcaatctatattgctgtcccgtctcaggcacagtaattatagtgccggggatcatcatgtctgctccaactttattagagtctgatggatccatattgttaactagaaacccaaacccaagagtggaaaaattactcatgctgtccgtcacggccacgtcataggcggcaattgctgtctcatcaccgtgggcatttttaagttgtaggatataacacacctcctaataatagaatctagtttcaaatgagattgtaaaatctgtagcaccagtaatcttcatttcattccaccccggcttgaagtcaatataaccatgatcagataatccgttgccgtaacactgtgaattattcttgactggaatcaggcccttaataaccagattatctgtcttggctaggtgcatgttgaagttccatttttggccggtagtcacattctggattgtaagcttattgctaacagtaccgttgaatcgaatcgtgactggtcgatcatctgccaaaagcggaatattggatgcattgtagaccttgaatgactgctgattagtgaatgagtaatgcagatcctcgccgttgggaatattcattcctagcccccatgattcagaatcataggtgaacggggagagtgtggttgcggtcgattctgcataaccatctggacagtccagattgactgatacatcagatgcacgccaaaaattattcagctgtgttacgttgaatgcttcagccacgactttccaccgtaaataagggatgcgcatattaatgacataaaatggctcatcactgcggaatattttcatcatcaacagtttctgcaattcgtagtcgtgcacatcagttgcaatgatgtcgaataccattggaatcacaagttgttgtgcctgactagaaatcaacttcgacccataattgcccacttgcttatagccgtgttgaaagttcgtgaatggcacatcgaacttttttactcggaatccgagtttacctaaatcgtagattgtgccatccaatcgctgaattagtatggttgaaccgaaacttgtaactccattcatcgaatagcacctccattctgcgacaagataatttgattagcttttagcaacttgagcttcggatactgtgccttagcaagagtccaactatctagtttaatagttagatctaagttacctgacagatcactatttgccttagactgtgctgattgattagcagctacctgcgccacactccgtgatgcaaagcttggcgctgtgcgttgaatacctgccttagcatttccaactactcgcatagccttagcaattaatccgttaggatccttggcagctcgtgctcgtgctgcctcaacaatcaagctgtccgcactatcacgagctggattaatagctacttccggttccccaggtacttcgttgaagatattgaccttgttaggatcgccccaaccgccgttagcgaatctacgatgaccttgtgggccactgtgcagccaatcaattttaggaacacccaaaatagaagtgtgaccgatactattgcgccaatcagagttattaaagaatgcgagcaaagaatctaacgggttcatacggtttttatgacccggcatagcaaacgcgttaaaggttccaggagtaaattgtagaattccaccagcttcattaccgccactattcatatcatgaatagtttgaatgacggatttcccaccggattcactcatgatggttgcttgcaaagcttggctaaatccagtaggcaacggccatgcgtgcatttctttggcagctttctcaatcaaactagggttatagtggccttttgcaccatcatatgaaccgccagaatcatcactaaacttttcaaagaaacttttaacatacttaatagcattatcaatcaaagaacttttagcaccactagcaatcgcaccaaacgcagtggtgttatcactgaacgtttttgcaagttttccaatacctgtcgcgttagcaatcttgttgactacgccactagcgccttcgctaacaagatcagcagcaccctcaacgcctttcttcaaagcactgaacgtgttggtcagccatccaggcaatccaatcttgtacccaggtaagcctttagccatctgagcaaattcaacagacataccatgtggcaaaatagacgcaccagcggggatgttacgaatctcagggccatcaacaccaattggcgtgatagaaccatcagacgtgcccatgtattcgaacccttcttcaccaacgagcgcagtatgttcacccatggatccattcaaaccagcagcgtgctttttccaagttggaatattgccccatttcttgttcaaagcatgtaacacgccattaattccgccaatcatgccgttccacatgcctcgcatattatcaatgaactcattccacgatcccttaacatcaccggtttcagtatctaccgcgcctttatgttcgccagcttgtttagttgcttcattaacgaccttagtgtgcgtttcctctgctttcttgacggtcttattctttgagaatcagcagcatcaatggaatcatcacgttgcttacgtgccttactaacgacctcttcatattgctttctgctcattgtaccgttttcgtagcgttccttgtcggctgcggctactgtttctttatacttatttttggccgcgctaacagacttatcacgttgtttattggcgttatcaatggttttatcacgttcttgagctgaatttctaattgattcagtcatttgctgcttagatagcttgcccttgtggtctttcaaactttcaagaatgtctaactgcttaccagatgaaattttagtggcttttgtaacagcatcgtttgatttattttcatccttggctaactgtgctaaatacttcttgcggtcgccagccgtttgtttttgaaatttttcttcaattttctttttatcagctaaatactttgcatggttattgccatcttttttacgagcggcagccaattctttgttcttttgtgattcagccttgccgagctttgaataatagctatcggaatcttttttcattttttcaatgttatttttctgagctttctcctgcttgctatagttctctttggccttatttagaagcttattggcctctttttcagtcatagaaccgttctgaaccagcgttgcataatccttgatagacatctgacgcttgtgaccataatacttgtcaaccgacttactcatttttttataagtgtcatcagtaactctttgtgctttattaatgctagatcggtcagttgtaactttgaatttaattttagcatttttgtttagttgcttagtcaggctggtatatgatcttgaaaattgcttatcattcaatgatggtttcggtttgaaactactgctaaacttcttagacatgtcgtgacccaagtcagacattttgctagtcagcttagggaacgttctagttatccctttttgaatgccaccaccgattgattgaccaagcttactaccagcaaatccaccaattacaccaccaacagcggtgccgacgactggcataactgcagatccagcagctgcaccagcagcagcgccaccgaccgaaccagtgaatccacctaaatgcttacctaacgttgctttagtcgtgccaaacagttctggcaacgacgcggcaatgctcatatatggaacagctttagctagtccacgagcagccatcatggctttgccaccgcccagaccactagctgcttctaactcggccgttgaagtagcgccacccttagaaaatagtcgtccaagaactttagaactaccagctgtagcagcagtttcaccggcttctttagtaacggccttaccgcccccaacagtaaagccaccaccaccgaacaaatcaaccatcttagacacagcagctgtttcgataagtgacttacgcaagcttgacaacatgccgataaactcaataccttttttgagcgcaaacatcgcaataaacgctttggtcaagttctcaatcaactcttggttcttggataagttctttaaagcatcatcaatcttgtctagtggatctttagattcttgggctttcttgcccactaacccaaacattctggcaatatcataaatgatgtcactaaacgtcttccagacagttttgccgataattcctagtatcttacccaaattgccaataatgtcgacaattgtatctttgtgcccatcaatatacttaatcaacttgacaaaccaagtcatcacggttgatatggccccagacgctattttggcgtacttcttaagcatgtcgtcagacaataagttccgcatgtctttagcaacacctttgctcatcttgaaagacgaagccatgatattaccagttaaaactgaccagcgggacttgatgtacatgctcataccttggaacgacgtcatcgcttccgaagtaccatctttgtacttcttacctagataatctaatgcttcggtaaattgagtagccgttagcttaccagcagctgacatcgcatataattgcttcatcgacttgccggtcgccttttgcaaggcttcaccgaacatagggaagcggttgatcatgactgacatgtcttcggcgctcgccttgccaccggcaacaatcttggcaaactgttcacccgattcagccagggcatcgttactcatgtgtaatgtcgaacctaaggcaacgaatgcattagtccagtccttggtttctttaacgttagagtggacatggtagaacgattgcgacatacgattgatagtgtctgcggcataaattgaatgttgtgatagagaattgatataatcgatcaattctttgccatcttttggcgcttcggttgtcagcgcagtccagacagttttcatcgtgtcttgttctttgttgtactccataccagctttagcagcgtttttaagccccataactagaccttgtacgccagcttgaattgcaccaccaaggaatgttcctgccataatctcttttaggtgtgagaaactatgctcggttgattccgactgtttcttcaaagtggttagcccttcggaagcttgccctttatccaacttcatgcgcgtggttactgaccgtggcatcttccgcatagtattttcccaatcaatagcttcgcctttctcggccttagccatcaactcggtacgtgcctgctttggaacacggtttaataactgcttgaaattagtaattccggcttcctcggccttagcaactaactttgcttcaacggggctattaaattcagctttaatcttgctgtgagttcgctcggcctcattcttgaccttattagcattgttagcaaaggattcgtccatctggttaccagcatcggatccaagcgtcttcattaaattattgactcgttcacgatcactcatgaatgatttggtattcattaacacatcaattgttactttcccgtctgccatgtactatccctcctttgctttctctgccaacatgccaaatacttgccccatctgactatccaagctcgcttgcgtgtcttggtcgtccaaacgataatagtcttgtgcttccaataaactagtaagttcttcgccttccaaaccgttagttgacttctgccgaatagcgacaatacgccgaaattgagttgtctcactaagcccgtccaacattgctttgaacttttcccaacgcagtttgccttgttgctcaattaaatcgatatgataatctgccataaacgatgcaaagatagcgtcagcatctttctcgtaactaaaaaagcgctcctgcggtacagggtcgccatttaaatcaacgttagattcatcatcgtgatcgccataaaccgtttgttgaacgtatttagatatttcagacacgactgaaaccatttggtccgcagtgacgtcagtgccctcgcctacaaacgcattaaacgctagataaatcttgtgagaatcatcgatagcatcatcgtcaagcaagatataccagcggagcacattgtcgaaacttaaatcgacagtccattcttcaccgccaatcgttattgttgtacagagtggctcaactaggctaagcattcacatcacttcttcttcgtagctttgcgtgacttgtaataagtgtcaatgtagctatcccgctgttcacgcagttcatcatattccttgacgaccatgaagaaagcagccgccattcgttcggtactcttattggttagttgatagagatcatcaccagcgccttctccaaattgatcatcgaaaaatgcactcaattcgccccgtaaatccttataaagcttattcaggaactggcgttgctctttcactggcttgtcatctagttccgtcatcttcttttggtcatccaacgcatgcaagtgcttgccaacacttaaacgcgtgtccaccagtttcatgtttaactcatcattgaagtaaagctttgcatggcgcttaccaaatttgaactctgcaaactcctgtggcccacctgctagattaattgctgtcataatataaagtcctcctatattttagtatgtatgagggcaaagccctcgttaactatgcttggctgccagttcctgcagcgctagtcgtatcatcttcgccaaactcaatcgtcttaccgttcttgtctgtcatgataggcttgccattgaacgataacgtaaagctgaacgtctgcttagcattggcattaccacccattggaacgatagccgtaatcgtaacatttgacacaatcttattgccgtcaggatcagtccaacgtgctaatgttttcaaactttcgctgatagcaagaaacttacttgcaacgtagtcttgtgcagcatctccaattactcgatgaccactgaatgctaacgtgatacgtttgccggttacatcagtatcagtaaatcctgccccatcataataggcagtgttgtcgtctgtttcgttagcggctggagtaacacccgaaataccagctgctaaaggtacgaaggttgccttcgttacgtctttagggtcttgactacccgcagtgtcaatctcaaagacgtttttgtagttcattttaaattttgccattttgtaactacttccttccttaattaaaaacgctattcagtgcctgtaaaagtgttaacgataacggaaaagctaagctgataagttgagtaaccttgagtgtcctgctcagatatgcttggctgcccgttaatcgttagtgattcaaattcaaagctcttgttgctgctaactaagtcatcagctgtcaacacgtccaacgcttgtgatacgagccacagcgttgtgttggcttgttgctggttcttagtacgcataccaacttcataattcatttgccactgctgattacctgcataatcttcgtcaagcactcggctacccggaagtggataaagtgacagcgaatcagcaaccgtcagatagccaagtgtgcatttcatcggcaaatttggcactcggttaatgcttgctgctagtcgttccaataagtccatcacttcatcccttccgtaaacgccttaacccagctatccataaacattgacttagctttcaagtcccagcgttttgtggtacctggggttgtgtaattatgaactggatatttgtcattgataattccgtagaattgtgctctagcgtatggtgtggagtatgttatctcgctaccatcagaagtagcatgtacagattgacgtaacggttcttccggacgatctttaggcacgaactgttccatatcatacatcgcttgattgaccaacgcatattgcccacgtttcacgttagtaagactggtctggtccatgaagccatctaggtcaacgttgattctaaatgccatcacagcacctccaattcataagaatgaagtgcattgctaaaaggttcacggttgtcgataatcttttggacggtgtactcttcgccctcaaatacaagcttagaaccgacgccgttcttggtaatcgttggtagtgggctactaatccctgcgtacaaaaaaacaaccgcgttagccacgattgtccgatcgttgttgctaccagagtaaatcgtctgtggttgtacaacgcaatgttcaattgtcactggcttgcctgccaacggttgaccccattcatccgttttagttggatcagtcagagtgagcgtgattgtctgctgacacatccgcttcggtggcttcatcatcatcggtaactcaccgccctacacatcaacccaatttgagccaagattgcgaccacgccgttagctaatccagttttaccaaaattggtagcattcacattagaatttgcctgtacgtgggttcggccaatctcaacgctggataagtcctgattagcaatgcccactggcgtatcagcgccaacttcatcgaagtagtcacactgcaaggcgactgctcgtttgaactgcttagcacggaatacttgccattgggtgccagccaagtcatcaaccagcgaatgagcggcgtagtcagcgttatagaagaactgagtagtaatatcgacttgcgtttcagcagcccgttcgtgttgatcaaagatcttttcatcagtaatcatggtaaaaccattctgttgatactctttaaacgtcaaataggccatctaatcacttccagtctagattacttaccagttgaagatgaagaagttgatgttccaggcgtagctgctacgtagatagctggcttagcattgtcaaatacgatagcatcgtagtatgacaagcctttgacagtagtacggtaaccggaacggtcagtgtcatcagatacgatgtcaaccgagtcatacttcgtaattggagcaatggcgctcaatggaagcaagaagaagttaacggcgtcagtgatggttaatccttgaatccgacccttagcaactgggataattggcacactaccgtcaatttgaccgactttgcggttaatcccattgatactcatgtcgttaacggagaacgtcttagacacgccgtcagcgttctttaatgccttgtagtaggaactggaaacgaacattgcaaagccaccaggaacttcattgtcaagcatgaattgttccgcgtcatcgtaggctgctaacgcgttcttactgtcaatcgtgtcagtaatcttggtgccggcgttatcaaagatggtttgagcaataaatttatccttgtgtggcaccgtaattagccgttgatgttcttctacaaggttttgcacggttaacgcgccactttctgacatatccaacttgtctagatcgtagccgatccaatcttcttgcttcaattcgattggtaccttttcaacattgatgttgtgacgaacgttatccccattccgaacatacttcgtagcttctgcgaagccgtccatcttgttgatacgtacagtgtgaacaccatcaaaatcggccgccgtaattgatttggcaccgccttgaagtggttgccatagttgtgattctgcagcaaactttttatcaattgtgtttaaatccttttgatctaaaactaaagtcattagttagttcctcctatttttccgcagcacccattcgtgctgcaatacgttgtgttagtgacggttcaccaccaccggtactaccgctaggattcccaccagcagtaatcttcacggctggtttaccgccgttatcgtcgctcttgtcgaacaggtagtcatgtgactcctgcagcttctcaatctgttcaccgatacccattagttgaccatcatcgccaagcttgacagtatccatgtcgataaacggcatgattgccttggcatcgcgagctttagcgtcgcgaagtgccatttgcacagcgttatcagtcttaacctttgttaagctggcagccgcctcgctgtccttcgtcttgatggtttcttgtagtgcggcaatctgtttgttaagcttttcagaatttccagcttgttcaccaagcgacttgatttgaccatcacgatccacaacttgctgtttaactgaatcaagctccgacttagcgtcagctacttgttgcttgattggctcaataccagcgttataaagcttcatcacctcggtcgtttgtttatcgtctaaccctaatgtttctaaatccttacgttccatgtcaatcgctcctaacgttatttattacgcggtaacggccgcgcgaattgattgcataagtaatgagcagtttagtgacgtactcaggtcaaattacttaaactaatacacccgatcttcatatccttctgggatttcaactggatcattatttttgatacgtgtttcaataaatgcggccaaattcttcgcaccactgatcgaaacatcatatccatcactacgtgtaatatctaaatgctcatacagtgggaaatcaaccttgaagttatcttcgtacctttgaattgcggcattcatgatcagtgctgccccatcttccacaaatagcattattttttcgcctccaccattgtatcaatcaacgaatcgcatattttagcggcatttggaaatatttctttaatcaacgccaacgaagctgggtttgctgcccttgatgaagtatactcggcaaaaaattcagtctcttgcttgccataatccttccaatattttgacccatggccagtgttccacggatgatcaaacgcatcatagcccgtgccttcaatcatgtcagacacattactatatttcctcatattctccaaggctgtcggcttggtatcacgaataaattggcgtatcttttcgacaccttcccacgatttgctatcctcttccatccaaattgctttttcagcctttttacgtggtttcttgcccatctgcattggagacttagcttcaccgtgattaatgtagtcaaataaatcctgcttaatggctgtcccaagattaattgctggatttccactaaggtgagacgcctgttcatcaaatttgtacgtctttccagctaaacgttgcttgatttgacggccagttggtatcaactgtttaccaaacacatcattcatagatgtgctgtcaattgcatgtccaatttcatgataaaccgtctccattggctcacttattttattgccttcaaaagcagaattacttaaatgaaccgtactagtgtgagcgtaattattagcggctttagatacatttgcaaaatcaagagcttgcccgtaattggcatacaacttgcgaagttgttcatcttttaagtttgaaacactactcttgaattgtttataatattcgtcaccaaaagcctctttgatattagccttatcaaaagcattaatgatgtccgaatctttgacagatgacttgaactcggttttatttggttcttgtgtaaccggcttttgttgagtgatatttgaactataaacttgttcccgactataatctcgatgtaggaattcatgtccattcactaattctcgtaacgatttctgttggttactaatcaatgatttgtagcgggacacgccagcatcatctcccaactcctgcgcagcagccaactttttcttagactgccggattgctcgttcgtagccacgttgtttagcttgaatatcgcccttagcaatcgctgcttgcgggtcatactgtggctggttgttagtattaacgccgtcaatgaacggataaagcgtgtggctacaattaataccttgtgtcccagctggtgtgccataaccatggttgtaaatgctgtcatacttggcgttgtaagtatcgctacctggttcggtaagattgacaacgtgcccttgaatataggcacaggctctacgagaagctgggtgtgaactcataacagctaaggtagttccaaaatcttgcatacgtttcaaacgcaagttattaaacgttcgatgagcagtcgtgttgataaccgtgcgagcataaccttccaacgaccgattatggccgcctttatcgactaaattggacttaataccagcgtccacccatttatagacgctatctcttaaggctctgtcgtgcgttttgaggccgactgcagtttccatggtggtttgcttgatgataccttgataagctcgcatagcgccattttgaccgtaattagtggacaataacgactggttaactgtgttgtctaagtctttccacgtttgattttgtaaagagttaatcgtgtcacgaatttcatcatcaactacgatctttttatgcaattggtggctcaaagtagcatcaatttcgttaacaacctgcaagccatcatcatgcactagcttctcgattgactgtttcgattcgccagtatattttgccactaaggcaatgacttgcttgtttagcactcccatcttgcttagctgttcgacttgccatcgaagcacattctggctatctaccgtatcgaagttggtcgtcttgagcgtctggataatgcgtgcgtagatgtcttgttcgagcttagaatagatgtcaacagccgcgttcgcatcgtgcatcatcgaatcttgagtgatcattcaccatcaccaccgccacccattgcaatttgtgagccctcataagtgtctgttggcgcttcagcacgtatcttggctaactcgtcctgtgcctcgtccgcagacataccatagttgcgctgcaagaacgtctgtttagacataccaccagcaatcatagtctttgtgtcctcttcaagctgcttgtccttgtcaacgaacacaccatcatcaaagtggcactcaacatcaagtggttcattagctaagtcaatatcaaatagtggcttgccatcttcaaatagttcacctttgcttgccagctcgaagattgccatacatagctcatcaattgccttctcaaccatagttagatagctcgaacgcgtctgataggtcatgctattattgctgacaacctcagtagctgtctttaacccgtcatttgagtatgagaacgtgccgcttgatagcccaatctgcacctcaaactctttaataaagtgattaatggcatctttatattgaaccgttcgaatggccgttgtcatatctttaatgccggtggtttggtcatcatcactaatcaaaccgacatataagttttggtccgagtcaaaggttggcttgtgatcatcatcaaagcgtagcatctccggcttgactgcaatatgtctttgccctagtcgaatctcccacataaactgatcatgaacatcgttaacgtcatctagtacgtccttggcgttatctacaacacccaatcccaatggactttcgatattgatgttgttagctcctggcgtcttaaaataggcaaacaacgggctttgcaaattctcaatcgttacttgttctgctaagtcctgatacaccggcaacattgatagcgggacctgattgccgactaaatcggggctgtcagacttatacagctcattagttatctggtaggatccatcagtttgccattgatgaaactctaacagcgtgtaatacttcgtctggtttccttctgtgacttgtgttcggctagcaatagcggcctcgctgatgtcgtttgtgtttgattgcagtgggtagaactggtcagctcgcacccaagcaatcttgatgtggttgccatcgatgtatggacgcattgcaaatccgcctagcgcaactcctttttcaagtgcttcttcaaatttgtttttgaagtcgttatccagcagcaccttatttagaaattcatcggcactattgttatcgttgatatgaatgtctgccttctcattgaagaccactgacgcaattcgtctggcggccgtcttggtaaggtttagcgtgttctttggtcgccgtttcagtacgccgagttggctctgataatgaacatagcgcaacttgtcgctgtaatagtccagatcagtttgaatccgaacatactcatctgggtcaatactgatacgaggatcatcggtaatcttacttaaacttcctgttactcccgtggctgccgcccccttccaaaataaatctttaattcgttgaatcagtcccatttaatcacctaccatctcaattcgaggtcgcgtagattgtcaagcacgaagtactgaaacgcgtcgcatgtatggtcatctaccttgataacctttggcttgtcgctttccagcgtgccaccgtcccattgatacttgcgatgttcactaacaaatatcttgttggcttcgttatcgagataataaaaacgcccagtggccaaaaggtcctgaacgtgatcaatcatcgctgtcttttcaatcttgtttacgtgatgccaatgccggccatacttcttgaaatactcatggtcaatcgcatagtcggacgttgcttcatcggctgaccgtttccaagccttcttgtgccattgcttctcacgactatcctcaaatgcgtacagctcgtctgctagctcgctaggtggcttcttaaccgactgatgagctggtgagtagtaataagtatctagtaagataacgcgcttcttagccgtcaatgcaatacatagctcagtcgtggctgacacctgctggccgctatcttggctgaagtacagcgacttaatgtagtcgtcatctgggaacacctctaacggcttgaacaggctcggattatagatattcgtacctaacccaataacttcgcccagatacaaccagcgatagtagtcgtaatcgttcttcttatactgctcgattaggtcaagcgtttgcttgtgggtaaagccacggacgtcgcagcgatagtcactcgtgtcaatcagatagttgtcatcctttgacactttatctatccattcgttaatccagtcatacgggttcttaggcggattatatgagtagaacactttgacctgatcaagccaatctggtttctgccgaataaacgtcgggttagcttggtcgaacacgtcactagacttcatgttggcggcttcttcgtaccagacggccactacatcacccacgatatttgacttgagcttgtacgggttgtcggcgccatagaagtagaacgtgctgccagttcgcttatgctgtatcgtgagtggcgatttataagcaataaactcgtcatccatatcaagcatgctgagtgcccattgtatctggttgtaaaccgtgtcatgtaagtcactcttgtttgccagcacagcgatgacgttcgccttgtgatgctgcatgatagccttcttgaccattgttaccagcttcaaactaataacagacgacttgaacgagccacggccaccgtttgcaacgatgtaaggcttgccagtcgtccacattcgcttaaagtgagggttaatcaagtccgatatcctaataaccttcttgatattcgtatcgtcaactactagcgtcttcatcttctatgcctcccacatcatcaactatcagtgtctgtccctcattactttcaccactccgtgcctctttggccttagcctctgcaatatctgcatcagctttaagcttgcgaacccgttgctcattaatattatcatcgtcagcaccaatcaacttagacaagctatccaatgccttttgcttatcgtacaacttgaccaccaagccatccttaccgcgatgaatatcctgcaccagtgaccaatcaatctgatcactcggtttcaagtagatatcagcaacgtgtttttttactgggttatcatcagtatcaaggaacacattgccatcggtgtctgtcaccaattcttcgtgtaccttgtaatctagtacatcaccaaggctagcaaacgcctgcttagcgtactcgtgagtgatgttatcaatcgttactagcagctcagaacgctgctgctgcttcagctccgcaagttggttcttaacctcaacatttctcaacagtctacttcctgaacgcatggcagtatcataatcacatttataagctttcatgtaagcccatgttgcattaaaacgttgcaaataaaagagacagaacagtttctgcttatctgtaagcttactatttgcctctagttcatcgattattttaggtgcaccctttttggcttttgtgtgcaccctttttgacttagtgggtgcattctttttagtgctgccacgttgccagccgtaacggcctttccacgacttgacagtatttaagctaacatcatacttattagcaatgtccttgtacttcataccagccatatagtcctgttcagcctgctcatacttttctgtcattacataccaccacacctccatttttaaacccgccgatttcgactggtttagaattaatctagctcaattgcttaattcgttttgacaaacaatagcaacgtttaaataaattaatttgaatccatgattcaacgtaagaatgattgttctcgtcgtatttcgttatataatgatgtaccatttactcaatttcctttcttttccaagttaaatccatcgccctgtaaaacttgatataccggcttagttttattttccaaacgaaaagcgccatgctgtttagcacgacgcttcttatccttataccatctatctagccgagcatcagcctgcacccattcaggcggctcgtacccgtatttactatgaatcatcactgccatgacgtcactcctaaatttatgtatcaaaaaactcccgccaataagcgagagcagtttgaaggattactgagaatacctgagggaactaaagccccctttcagtacctatatacaataccacagcgcgcctgttcctgcaggctatctggtggccgtttgattgcgcgtcttatgtatgtgccgtccagttttccacgctgaatggcaagcgagtaagctgagttattgttgattcaaatgatttcacgcactatcgcttgcatgcttacttgcttaatgtgcttggtagggatttgcaccctacatgttggatatattcagcatctttaccaattacttgcaagtgtcgcgacgcccttgtaaaaccaacagtcacaccctgaaacagggccgccacagcgtctacctattccgccacaagcacatgttacacagttttagccctcatgagtgaccatgctgcataacaatatcgccggtaggactcgaacctgcatctcattgtggcttaccaattagcccacagcgatactcgcattcaacggccgacgttaaatacgaagactaatgccggcggcagagaggagcgcatcaccccttataaatccgccggcaacgtagcctgctggactcgaaccagcgacaacctgattaacagtcaggcgctctaccaactgagctaaggccacatgaatgttaggaaatatgactaactttcccaacatttaataaaacatattgtataattagttattatatttgaacggggggtgaattaacatgtcaaacaagatttcactgagtcaatttcttaacttttcagttaaagttcataccagcgcaaaaatcaatgtagttcgtcacatgaagaatgatgagtattcaatcggacaggattactactttccattacgtactgctatacgtcggtatacacaaggcaaagacacacttgattctatactagacgctgcacaaaactctaaggaagaccgcagggccaacttcataaaagatgcaactaaatttgtcaacttcatgaaaaaacatgatgttcaattttttgaagtaggaaatgcttcttggagttatgacaacaggatcaatataagtgcttctccagaatttgggatgatttgtaatggcaagcgttattttgttaaaaatttttatcgaaaacagaatcctaaggataaaatcactttaactaaaatgcgtcccacgttaactctcatgagaactgcaacttatcaaacagatttagctggtgcaaacgcagccgtcctcaatcttcaaaatgggaaacttctttttgatgacaagcctattaacgcaaataaattgcttgaattgcaagcagatgccgcgcaattagccgacatttgggaaatggtctaatatcctatttatcatgttcaattcccagatcattcataacttgtgcacattcatcacaaatccatgaaccatcatcgttttgcaaagttgccacctgcccacatagtgtacagtgtggctttttaatatggattaagtaccagtcatgtatccataaacgtaacgaaataaacatattatcgcccttttcttaattaccttatgctactaatttaccacaaatttattgctatgaagtccggcttgagttcggaaaaagttcggttaaagtccggtttgagttcggttttgataaatattcaagtcttctaggtagtagctctgcgcgaactgtagcattgccaatggcttccagcggtcaaaatactgagtcttgctgtaaccaatgtccatgtagcacatcgtgtcgctgtatccttgcagatatagccgatctaatatctcctggcactcatgatcacaacgagccatggcctgaatagtctgtcggacaatctgctcagcgtacaggcggcgtgtaatccgatcctcggccgagttaccagctggggccgacttaggcatgccatccatactaggcgattttagatcagcgaccgaatggccggacgcccgaactgcttgcggtaacttcttatccaagaaccgccgcacctgtttaattgttttctcttggtcaattggtggaaaaatttcatctgaaataacttgctgttcgcccatcatgcgcccctccgctttcgtatgctataattaacttattcggaattagttgtagcgcggtcagcgatggcagcgcttttttatgttatacttacaacggtcattcgagtggtcccgtgactggtcgccttaacgggcggctttttgtttgcttcggcgtgttgcttcatgcgccggtgcttccgtttaatcgttgaacgcttcttagtgtgtttaagcattctcgtcctccgtaatttcatctatttctactcgcggatttcgtttatcaactgcaaattcgtcctgaaatcccgtgatatgctttcgattgtcgttgcctaaaagcccagccttcataaagccgtcaagcacaaactttttagcaaacgcgatattatccgcatcttttcggttgtttttcgtgtaccacgtgaatttgagcttacaaggccagctgaattcgactccagaattacgacttgctcgcgcatatacactacataaggccgtgtacctcttctttaggttagctgccgcataccgattggcccgttcagccttgatgtactcatttaagctaggtagttcgcccttaatcacgactttactcatactttcggcacctggctaatgtagtagccacagacaatgccatttgagtagcttgcttgccttatcgatctagctggggcgctgatcttatcacctagcaaatcaactgtttgtccagtaataatttcgttgggattgtcgtacttttcagcacgccagtagccgttccgcaacggcaaactgtacttgtgcactagatagctaacccgctgactaatatagccagtctcatcggtcaacgcccttatcgtatggttaccatcacgatgagcacggcgaatatctctaatttgctcacgttcctcagcttggggatctggtaacatactagctaagtaagcttcatcactgcgtaccttagtcccaggcttaaccagtctaaccggaaacggccattcaccagatttgtagttatgttgcgcgagcttaaacatttccggttctggcccgattgctagtgggtgatcgatatcgggtagatcagcgttaattactagcacctgtgtttcagtcatgcgctcacccctctttgaccattgacttcgatttcaaaaatttatcggcaaagtattgctgccccttgcccgtaattaggggcgtaaagcgtgtctttgaaccatggttagtggtgatcacggtttctctcacttccatgattcccagctccatcgctcgttgggtcggtgagttgtaacgtttccccatcgctattaggtagccatgagttcttaaccaatcgaacaagcgattttgaccagtcttaataccgcgctggcgtaataccttagcaaaattaccaacgctgatagaatcatctgagcctgaaactgcttggcctaatctagctggcccttgcaactgttcattctccagtttcagctgctcgttttccctcattagaaacccatatccgcgcttgacaacctccatagggctgttccatcgtctttcaacagctaggaaatagttacgataacggctaccattttggtttctaaccatcattgctaattgcttagccatgtcaagcgtaataacataatcgtcaatttcccgtacggccccattgttgacaaccgtacttgatgtacacttgtcaaaatcgaccccttcatcaaacaaagaaaaattattttcgacccaacgactaaagcgttgtgcgatttgaagccctttatatagatcccgggcagacactaactgccgtccatctttttcagtgattttaatcaattcattcatgcgctcacctcttttacttgtcataggctaacttcctttcaagctcttgttcgtaatgagcgtgtatctcattcgtacagttagggcacggctgtacaacccagacacctttcataatctcaacatgtacaatttgtgttccgttacattcacacattagaacgatacctcccgtttgtctggggtcgcagccgtaaagctgatgacatgcccattgatgccacgatatagacgcgaaatgatttttggattataaacgctagccaagtcggcactgcctaagttggtcgtgataatggttcgttggcggttgttcacgatgccaaataacacattttgcacgtaatcgctggcttcctttcggttcttgctttgatggctttgaaatgttgcctctgagcctaggtcgtcaagtacaagcaaatcggcgtcacttagtagctgaaccatgttctgctcgttatatcggctgtcaggatggccgaaactgcttttgattaaccggaatagttcattcacgctaacgaacaaacacgccatagatttatctgcgtgatcgtttaccgctttggcaatggataaggccaaatgtgacttgccacgccccggcagtcccgtcaatatcgtgttgtacgtggttgctggattcaaatactcaccagcaaacttccgtgccatctttaggttattcgctgactccgaactgttcgggcggaaattatcaaagttggcatccatcagggttggatcatcgaatatcgagtccatggccaacacgtcagaggttcggcgcttatgccagtaatcattggcatgatcaataatcttgtggttttgctgttcaatcgcttctttggcacataccatgcagaatggttgatgcccctgcatgtaaaccatattcaccccatgccgggggcaaacttggtcactagtctttaatcgttgtagctcaggaaagctaatccctcgtgcactcttagaagtcgtttctgacataggtttgcgcctccttcgatgtctggttgctaccatccgctgctggttgcgtagacggcgtcatatcgtactcatccatccagccacggccacccagccagttttctaaacttttggtatagtactcacccgtgccatgtagctttaagtaagccttatactcgttaatcttggcaacaatggtctctaagctaactccctcaacttgggccgcataatacgcgttataagccttttgaaagtcacgcttttttggatagattgaccaaacctgttcggtaaactcttgctggatgcggtcacgaggatcacgcggtttggttttattttttttattattatttgatttacttttatttactttacttttatttactttactttgtggattaatgtcgacattaactacacttgtatctttattaatgtcaacattaatccaatacttagttggtttctgtgattttcgacgtttagtagcatcttcataggtctcttggatacgcaggctcgttaataccttagccgaattgaacagttcctcgctaaaggttccataagcaatcaagcggttaacgatttgattagttaattcaggtgatacgccttcaattcgattagctaactgcatctgtttcaatttattccactgcaagtagtatccattctggtacaccgcagacagcagataaatcataaacagaacacctttcggtccaaactcacccataatggcttctgtcttgtcgtttacagcaaaatcaacgtctaatgggaagtaatccaatccctcttttactggacgggccatctcgcacctcctgtccttattaatgggcctttcacccgttcggtggattcagtcactgctgcattcaagccaattctgtttcatcaatccatgagcaagtcgtctgcactaacgacactctctaactttttggtactacgacaataagcacaatgtccgcattgggtaggatctgattcgcctttaatgacatcttgaatatgctgttgagagcccaatatctggttcatagcattagtaagtcggtactctggtaaatcaatagcctgcttgtctggtggatcctgtttgcttactgccacgatgtacggtttacacatcacaccgaactgctgcttaatcaactcttgatagactgccatctgaagtgggtagttatacgcatatacaaacggttctttctcacgagtttctggattccaatacgccttgtatatgtcagcggtcgtcttgagatccacgaagtatccttgtttcaaattgaggcaatcaatcttgcccttccagggataaccaccgatttcaccagttacaatcacttccttatcgccttgataaagaagattaaaatcatggtcgtcagataagacttcaatcatggattcagcaattttgaagtccttttttaggtggcccttgctcggtcctcggcttgaaattgcttcggagtgttcatcaacaaacttcgcatgagcctcctcgctctcaaaatagctgtgaagccagtttccaacgactaacgccgttgatttcatacacggttcccatttaccctgcaactcggctaacgcttctgcctcacaggctaaaaacttcttaaaccatgttgctgacataaatgattgatctgtccagtgatcgtaatagttagctggcgtcaaggtctccgaggttgtcgaagaggttttgctggtcgacttcgtctttgacaggttcttgatcattgcttgatgcctcctttacagccgttctaacgggttctttagctggttcggcagattctaccttctcggctttattctctgctacatcagctttcaatgaccttttagtcggtgttacgtcttttctatcgtcattctcatattcgttgctagtggtttcgttaactgcttgcacgaacaaatcgttatcacttgagctgttaatgtagaacttagcagctcgattaatgacagtccgtttagccatctcttctgggaactcgttttgaaccttctttgtcttagcgtggctccaactggtgtcgatgtccttttttgtcataaccgtgtatgtccggttcccattgatgtcttcgatccatgcaaaggccccgataatttgcttatctaggttctcaaagcttggctcgaactctttaaccaccaacactccatctttaccaccaatcttgaacgtgtcgtctttgtggacaacctgtgcctgaatatccttaacgtttgaaagacgctttacaacgctaattgagccaaaataggagcgctgcatgactaactggttgccataaggaatgaaatagcattgattcttagctgggctcaatccttgaattgccatgttcatcaacgccttgataactgatccttggtcacacttatcaagtaatggttggcccttagacgtatcactcaaaatcaagtaagcactgtttaatgcattccctactgaataatcaggtggtaatgacaagccttcattattcttcatatcctcaatattgttattaaccatcgtaactaactcattactcatgcttcttcctcctctgatacccagtgatagcccagacgtgtcatcatcgtgtccgtgtcgatgtgtaccagtagctcgtcccatagacgggactgaccaaacacatcaattaaccattgccaattaggttcctcaccttgatctggatacaacacacttacgtcagtcgaaccaaaagtgacgatacaaatggcgttcaacatatcggcctgcatatcagtcgcccactgctcaaagtcattgttatcgatgtaatcttgaaacaactgtgccttgtcgaactcgtcaccatcgtagcaatagttatctgcgtcaagcacccagtcacgtgagtcgttacgttgctgccaatgctcgtttaaatctgcctgtgctggtatcatttcgcccacctccgtgccaaacgttgtcttagtgattgtttcggagtacaatagaactcgaaaataaaattattaagcgtcttagctgcacgggtactcccaatactcgagcagctttttttgtactcaaatttaggctttagcgatactttgcgtacttccaattcgttcgacctccttaaatgtgccaaaaacattattcaattcttcaattgtgatttgtttgtaaagcacatttccaatccggaatgtaaatttcatcgtcttcatctccttaaattccaaaccagccagcaacttcatgacgcttgaaccataatgcagttagcacgcagcctactattgctccttcaatcattgctatttcctcctagccattttcttggttaactttatcgattacttcctgcaatttatccattggaataccggcatactcagccttcttagccaaatcggttatctcggcgctaatctcttctgcgtattcacgtggatagcgttcaataactaattgctgtgctggtgttcggtctctcggcttgactgtaatagcttcttcaaactcaacctcaattctttctcgctgacactgttcctttttctgtttcatcaaagccgagaacatatcaccttgtagctgacgatcattctggaatgacagcacgccgaaattctcacgagcaccagaataattaagccaaaaatcgttaattacatttgctaacgacttccttatttgtgaatcagtgcttcttgatccactcttcaaccgagacaattgtccgggagaaacatgcgtcctatctgcaatctgctgctgtgttagtgttttatttttgcctaatgccaatgacaattgctctgcaaacttgttcttcatacctacacctctatattttggaaagggctttatatcgcctttccacgtaattcacctataatttaaattaatcgggatgatctaataagtaatccatcatctcagctgctggaatctgccagccgttatgggtattcacataatcaataaagccaccctgttcaatatccaaatcatggcgatgcttggttaaatatcgtgaggctcgttcggttgatttagttccgtatttatacctggccaaatctttaagcttccaagtacgaataccacgctgtgcttgctgccatgcttggaacctctcatattcttcttcgctaatgaattggaaaccctttggagcctcatgccgaatcaatatcgtatctgacatgttcgcacctcctaatatgaaaatgacataagttggctagcttgctcgttatactcggccgttactgctcgaaattcagcatctagtgctttatcgcttagcgcctcaaacattattcttggtgtttctggcttaacctttgctagtgcattgattaaaacatctcttgttattggcttcattttgacgtctcctttttatgactaatagtcatattgtttccacgtaaaagatcatcaacagttacgtttaacgcgtccgacaattttagaatagtatcagtagaaccctttcgtctgccattttccattgattggaccattgctacagaaacttttgcatgtcttgctaactcttcttgggttaaattcattgcttctctataatatttaagtttcaaaatcatcgctcctttcatgtactaatagtactatgtctatttgtacaagtcaagtctttttgtacaaataaaataaaaggtctgtcctttactatctgtacaagctaaaatactaattgtggaggttatcataaatgactattggcaaaagaatagcaaacctaagaaaacaaaaatctttaacccagcccatgctggctgacgcaatgaatgttagccaaagcaccatcgcaagttgggaaagtgatagaagatccgttagcaacgatgacttaataaagctatcagattactttggagtaacaaccgactacttgcttggaaagaacggtactccaaaatgggccaacgagaaagacactaaagacttacaagattttttagatgcgaatgaaggctcaatgacctatgggggtgaagatcttactgaagaagaaaaacaacaagtgcgtgtggccatggcaacaatattctggaaacgccacaagcatgattaggagttgtacttatggatagagtaaaagatatcgttaaaactattgtcaatcgttatcacacagcggacccgtttgtaattgcggaaaagcttaacatacaagtggaatggtgtgattttggggcaatgcctctaggtaaaaatgcttatgacaaccaagagcctatcatactactcaataattctattaaacacacgcctacacagtatttcatactcggtcacgaactaggacacgttatattccatgaggggttgattgggtactacacttccgttaaacatggacattctaagtttgaacgtgaagctgatgaattttcagttggattgatgggaatgttgtttattgaggagaatggccatattccctattcatacagagaactgtcctatcaatacggggtaccattcgacggagattaatataaattaatttggaggaattataaatgaaaaagatgagtattggtttcatagccgttatagctataatttttacactgatcggttgtggaaacaaaaagcctgattatactgcttcaacagcagaatcagcattaaatgctaataaagatattgagggaaaaaccgttcaattcaagatcaataaagttgttccaaatagcgcatttggttataaccttgaaactggcaagcacttgaatttcgtaagttctgaaaatcccaaggtgaataaaggtgaaacagttacggtaaaagttaagaaggctagctcgtctgtgggttcttgggttatatcatacacaaatctcaaaaaagattaactgtaaataattggcccttagttgggctttaatgtgagtgtagttcaatggtagaacggttcctttaattcaagtataacctactttccgatgcaggttcgattcctgccactcgcattgaccagtcaggatgtcatgaaaagctcaaacatttatgtttacttatacgaacgggatctattagaaaatattgatttggaggagtaaattttgattggattaattttagctatttttatagctctcacacttttcaaagtcactgcaaaggtcggcagctttgttttactgattatgggagcagcgttaatagtaatggcatttgttaacacactgcaagcattagtgccaattattgcatttgggctcattgtatacagtatttattacttgattaatgaaaagctgaaatggtcaggcagacaatttactatgtatttaatggggttcttaacactaatcttcccttttatgaaggtcggtcaattatcaatcgttactgccggtatattttattctctgttcgctttagaatatccaaagtatcgtttatttagaagcatctctactactgcttggattatatgcgtttggataattgctgctgttttatttgccctaagttttattatcggcccctggcttgcagaacacggactcttaatttagtcattctagcagaagagtaaaggtaaacgctcaattacaggggatttctatttggaaaaatattaatttggaggagtttcaattgaaaaaaagattaaccatcggtgccgttctattggcatcactagtactagcttcttgtggaaatagcactaacaaatcaagcgaattaagttcaaactcaagcagcctagtcgctgctaaaagaaaaaaagcaacctctttatctgaaagcaaagttaaagctagttctgaaagctcatccactgctaaaacggcgactaacaatagcactcaagttctaactaagttagtttcatatacagacaaagagtctgccggaccaacgcaaaactattattgggacaatggcaaggccaagcttactaactttgatagtatgaaagctggtaaatatgctttttcagctgataatcaaggccgctcatcagtagccaaagctatgcttacctatgctgagtaccaagcttctaaaggtagtcgacaaggaacgcccttagatccaccttcatggccaagcaccaaccctaaagtggctattcattatggattaacagatcgtgtttaccacggttttctttacaataaaagccattcaattgcagatagtcttttgggctcgggatcatatacatcggaatataattttacaaccggcacaaggcctcaaaatgttggtgcaaatcaagaaggtggtatgcgttatgctgaagagttggttgaaaactactggaatacgcattctaactctaagaatactgtttcctacgaaacaactccactctataaaggaaatgaacgaattcctcgtggttcgctggtagacattaaatcttcagataaccagctaaacaaagaagtggttgtaattaactcggttgaaggcatcaaaattaattacaataatggtagcaatgatgccaaagcttatcaatcttctagtcgctctgaatcaagcaaaaaatacgtttctgaagcacctaaaaaacattcagaaactagtacgactaatagctccagttctgtctcaacaaaacagaattccgcatacactactaatggctcatggacagtggccgcttccggcatggtatttgtatccaattcaaacaaatattatagccaagtgactaatccaggtaattatcaatatattagtcaaagttctgctcaagcagatggtgcacagcaagctagtcgtggaaaccaatacgcaagaccataacaattccaagcccttcaccgggcttcacgcgagcgtagttcaacggtagaacatgtccactccaaaatagagtcccccgctcttatcaactactatgcaggttcgactcctgccgctcgcattgtaataaataacccatactaccgcttactttagtacgtacatcacgtgggcgtaattcaatggtagaataacgatttcagcccttctctctcgtttgaaattgttatgtaggttcaatccctgccacccacttttaaaagaaagaaggtaagattatggataaagatatgtcgaaatacgaactcatagataacattactaatgacttaacctcttttattaatctgtatgctttcgtttatcttacaaaagatagctactcaaggaaagaatatgaccgcataatccaaggaatggaaagagatatggttgatcgtcttaagcaaaaataattgtaggtacattctaattaactgttgagccgaccaaaacccattgttggctcttatgcgagtgtagtttagtggtaaaacgacagccttccaagctgtagtcgcgggtccgattcccgtcactcgcttagtaaaaaatgattactttggaggaaatctgtatggatgaatcaaattcagtcagcacgccaatattgtcaattccagaatcaactaactactggttagtgagggctgatggtggaaaatattactctgattttttagaggaaggattcattgcaattgctaataacaaaataaccattgcatccattaacaaacggaagcaaagttctaattcaaataatattaactacagagaactatatcttgatgcatatccaaacgaaagtaaccagactgcaggtcttcgtgctaaccagattcgtagatttgccagcactatgaaaattaacgatatcgtgctggtacctgctaaaaactcaacaaattttcttatcggagttattactagcagtgcatatgatgctaatcaagctaatatcactaaaaagatcgatcttcaaacattaaatgcaaatcattctactatttgcccgtatactaaacgtcgagacgtaacttggattaaagaaatttttaaaaatcagcttcccaaaggattgttgtgggcattatcagcccatgaagcattatttcatatacaatcaattgacgatattaattcaattgaccgtctctttagcccactttatattaaaaacaaaaatgttcactttcttatcagtgctggcacaaacgaaaacttaaccatgaaacaatgggatgaatttatttctattttgaagactgctgatattgatccaaaattaataaaggtggatattcgccgtaattcgcctgtctctatgaatttaatcgctactgtaataaaaataaatgagctctataaattatataaagccatagagccttttttagaagcaggagtcttaaccactggcacaggtggaaccttacttttcgcatggcgtgtaattggtggtaaacgtggtaaggaactgggattagtagaatggtgtcaagaaatttatagacagcatttagaaaataaaaagcttaaatacaaagttaattataagatagctaagcaaaaagattcagagttaaaacgagcaaaattacatcctaaagttagtggaaccttaattctacctgaaagtaaatccatgaatcaggatcaggaatcactttcgcaatcaacaaagttacgggaaaaacaatcaaaaaaagtactactaaatcagcttgtcgagttattaatatacttatcactttcagccaaaaagtaattgttgttgataataaccagtaagcccagatcttttttaacattgctttccccccttttttataattatactcctaataaaacatcttagagatggtattatttagcaatgaattgtcaattaaatgtgaagttacaaatcattgtcactcgcttagtacccctttattggggtatatattttcagctcaaaggaacatacgtttgggaatgtcaacctattgttatttccagttgggaggaataaaacatgtcagtaaccaaacttaataatggtaaatggcaagcccgtgtctcttataaagatgatgacggtaactataaatcagttactcatttagaaaagcgcaaaactgacgccgttgagtgggaaactaaaactaaaaatgctctgctggaaggtgctgacttatcacgtagcaccgagagtctaaagcactactttcttgattggatcagaatttacaaaactgacggcgtatcgcgtcatacccacgagctatatatgggcaactggcgccacgtctctgcctattttaaggataaacctatgagcgcaattaaacggccggattatcagaaatttctgaatgaatttggtcgcagtcatggaattgccacatctcacaaacttcatcaacaagtacacactgcaatcaaggacgccgtagctgatggtattctaaaacgagactttgcttacaaggcacacgtcactggacgccctcctaagcccgtagaggaaaagtatttgaggctgtccgattataagaaactgcgtaaatacctcattaaaacggctgattatgatcacatgactatgctaatgatgttgtttcaactagaaactggaactaggttcgaggaagctgctggcctaacgtgggataatttggatttgaataatggaatagttcacattaaacagcaatgggacgcccgtagacagacttttcgtccaactaagggaaatgggcaagccgatggagatataaccataggacccgcttactgtcgttttatgagggcctatcgcatcacacagaaagattatttagaactacacgaaatgaagaatcctaagaacctcgtattttggtccaaactaggaaaaatagtgggcaatgggaatgcaaacgaagagctaggacgtatttgtaatcgcctaaagatcaataaagttacaacacacgccatgagacatacacacgcttcgattcttatcttaaatcatgagtcccttccctatgttcaacatcgccttcgacatcaaaaactagaaacgaccgttaacacctacgtccatcttattgaagaagaaaacggcgtgtcagataagaaggctaccgagctaatggacgaaggattttaaaaatgataattttattattgctgtagtccttgtgccacaagggattacaaaatcatttgttaatttttcttccaaaaactgctatattttgactacttttttcgtttttggaagaatcgtggaagaacatatcgtgtttgagtggttttcgagtgtaaaacaaaagcaccaaaacgcctttatatcagcgttttggtgctttgccgtttctctatatttgtcgacttatcacccgcacggggatcgaacccgtaactccgccttgagagggcgacgtcttaaccaatttgaccagcgggcacaaattcatttattatcttaccgaatgataagcggcttgtcaaatataattaagatttttgccacctaaaaatcgtcacaacaactaaaccaatgaataagagcaaacagtaggccacactacaccaaaaaacgaaagtcaataattggggtaacaaaaagctgcgcataactgctaatccgatggccgtgaccgcccatacgatcaattgttgtcgcagatgatcgaataaatgatctaattctgacttcgacatacactcaccttccactcaactagtttagccaccaactgatacgatattcaagcaaaaatgcaaaaaatagacacaaagtttcagcaaagtcttgacagtatttgctggaaaagttactattaaatagttgttattgggtattcgccaaattggtaaggcagcggactctgaatccgtaatttactggttcgagcccagtatacccaatattcgttatcagctgttatcattggttgtcaaaaacaccgtgattacagcttttttattactctagtttgtcattggttgtcatctcttttcactaaaagtcagccaaaaggacagccaaaaatataacaaaaaagccactgtttccagtgacttaatacttgcgcggggcagtgactgttagccaactttggttaacagtttttttattgataagccattagtctaacgcttattatcaaggcaatgactgcgatagtaatgtgtatcacaaaaataacctttcttatagttttaggttcatgataatcagacggccaatgcaaaaaatcaagcactgacaaaaacataaaattaaacgttaataattttattccaaaaacaggtaccggcgtagataaacataaaactatggggccatcttgaaatatgctaaaaactatcaaataagccggaacaattaacaatgtaatatttaaagtaacttcaatcaaccatttttttataaaagaactcatttacaaggacactccagcaaatatttaactgcacattattaattatacaataaaattgttgaagtttggctatagtaagcattcaaaccgttagatcactgtaaaattttgcaaaagcgtgtaatgcttcattcttcatataattaaacttgctgacactaaccgataattggccacaagcttcactgcggctgaaacgtttctcaataatgtaatcatgtaagataaattgatatcgcggatcatcaattatattgagggcgtcttcgaattcttttaactggtaagccaagtcaacgtggtttatcaggcggctttcagcgccgtttcggctgctatgacttgatactccatcgaacgagggactagaaacttgattaaaagccgtcaagtcacgttttagtttggcatattgctttaataaattacaaatcttcttaacatcctggcgcattgaaatcacactttctgatcccagatatatgtattaaaaaacggggctattgcaccccgtcttgactaatatcaacacttatattatagcacttaaaacaattttttcaactataattgttttaaatgaagcatattcactttaaaacttacccggttactaaaccgcgcaattgttgaatcatgctgacaacttgatacggtgtctttgtcatatcggttacccggttttgataccagaattgtgtcagcaaggacacggcaaaatcgtactgtttgtagatagtcaaatcctcacttttgctaacggccgtctgaacatagtcctcggcggcgtctaaatagcttttaatcattggatcatcttcggtcacatcaattcgcaggcttagtttaatatcatcaacggttacagccatgcaatcactcctttttcccttagttttaatttatgtatagggggtgccaaattgccacccccttgtataaccgtgcccaaaagtgggtacgattatttaccaggcgtggtttttaacgccacgttgattacagcggtcttatcaatcactttataatcgttccgcacaatgacggaaagaccttggctaaactggtcgaacttgtcccattgggcggttacttggttacgccggaaaaccgccaccgcttgtgataagtcccctacaatcattggggacgtcccgtcgacgttgttggccagtaacttgtcactaatcatgacgactggcgcccctaacaaggtgaaaccactgggtgccgttgggttcggttgtaacaggtaacggccatcggcatctttcaaggtatcaaggtagttgaacccggactggttcactaaccacattttgctcaaagcgggatctaacgtcacattgaaaatctttttaagatcatcaatattggcagccgttgctttggtgaaactggttcccgttaacaagctcataatctgcgtgttgtccgtgttatcaaccaattgttgtaattggtttttaacttcgccgacaatatctacttcggcgtcttccaccacttcattagataaggcaatcttacccgcccgggtcttcacatcaaatggcacttccgtaaacatgttcgcgttaacgtcggcaatgtccgctagttcttccttagtagccaataccgcagattgtcggctagtagcaattggataagtcccggagccactagaaacttgcttgactgtcgcatattgggcaagattgtaattggattgctttaattggaagacgggagtaatcagctctttaggaataaccgcactgaccccgtcagtctttaaaccgtcccgtgtttccccgtgtgtccgcacatattgttcaaatgctggaataccggttttgttttcattgccattaggatcaataattgtttgttttgccatgttgtcaggctccttttcttggttaataaatttttcgtagctacgagtatcaacttgcacatttgtatcgtcataagcgggaacggctaccactgacacatcgaacaaactcttaacttgattaatggtgcgcgtgatattaccgccatcatctttagtccattcgtcggtgtcgtcgtcactatcaaagccaaatgagcaggaatcaacgttcccactttgaacttcttcgtaaacatcattagcaaacgacgtattcggcaactgcgcggtgaaatgtagccccttgtcgtccgtttctaacgttaatgtgcccgccttggcactggctaatacttgggtatagtcgtggttattaagcataagaacgtttgataaatcgacaccatcaagggccttaggggtaacaacctcagtgaagccgcctaagtctttacttggtgagttccatacaattgcataaccactaattgttttgcccttgcttgtttgggaatctttaggttgcgggtctgctgaattttcagctggcccgtcttcgggtgtttctgactgcggcgtttgtgctcgcaattcggcgtcaatcgttaaccgtcggtcttgtttcatgaattagtcactccattcttttgtaagtttaggaaaatatcgccatcatcagttggggataagccaatcttggcccgagcttcattgcggctcataatgccgcccgtatagcccgctactgcttgggcttgttgcgtttgcggatcaaggctcaatagcttgtccgtattaaacgtaaagtcatgaccaaacttgaacgacagctcgctggtaaagctatcaaagtaatgttgcaacgtcccttgtagatactgcacgccactttgttcttggttagaatgatcgttttcaacccctaagcgctccggtggtaagccaaaagccttagcaatttgtcgggtcgtccagtcattagaattgaccagctttaatacatcggtatttaaggataagttgctaatgtccatcgtatcgtcagtcacaatcgtgtttaccgcattgtcacccgtattggcttcatcaaactgtttacgaatattgtccttagcttccggccctaaatcagattgatggactttaataatcgtggtgccgtgcacaccagcagtaaaaaagccggttagcaatttattgccggccgactgaatctggcgttcatctttgagggcatataagggactaatccccgacacgccgtctttggtgaaatatttaaaatgtaaaatgttgttaggcgcaatctgacgactgttaccgccaatcggggtataggtgtaggtcaatgccccactgacgtcatcttgttcaaccgttaattggttattggcaatcaatttcaacgtatgattaggcaaaatctcggcaaaactattaccattcagtaacaggttagccgccaacgcatatttaaaatggtacccgtccatctgactattgggattctgattaatcatcgtgttaaagattgccgtatcacacataatcggattgctggcaatatcgctcgcaataatattaatcgccgcgtaaatgtcactattacgcaacaccgccgcactcacaaacgtatacgggtcgttacttgataaactaaccaaggcgtcggccaccggatcatgcgtgccgctggtggtattgcttttaacgaaaaaactcatttaatcacctctttgcttttcataattaattagcaaggccagcagaatcatggctataccagccaatattaaccccgcttgccagctgatccagcaaccaaaaccaatcactaagcagattaagccaatcaccaataagatcgtttgtacataatcagaacagatctgccgcagtcgctgttttgtagtaatcttctgcatgctgttgatcctcactttcttggtaatagtccataccagctacaaatgcgttaatcaacgccgcaatcgggtcaatccggttactattacgggctttatccagttgccaaccattgtttatcactttcaagatggcgttattgaccgcataagcgagaatcttattgccgttatgtttaatcttgccatcgtaaagctggtcacgaaagttacgagttggaatattcaaagtcttggtgccttgtcgcacttcaaacagtgggtagcttaatttctcgaattttgtaattaacgtttgtgcgttatacgggtcataagcgattgctttcactttccagttgtattttccgaccagtttttgtacaaaatcaaatagatcgtcataatcaataatgccactatccaatcgggtgatactacactcacccgcccgctccattgacctgtaatcaatgccatcacgtttaattttagaatcgagtccatacttcgttccgatgaatgaatgactatcacaataaaactgaccgttgccaattggaacgagccaactgaccgcggtcaagtcattactttttgataaatcaatgccaatataggcgtcgcgattatgtaagtctggcacctttgacaatttaccagtggcccaatcgtctgctgaaatataactgtcctcgctggcttgcaaccacatattgaagttcttaaccagtattggaatgagattattttgtttaatggcaaggtcaacgtcggcctgaatcttttccgtcatgcgttgtttaacgtgtggttcactgaataacgggttagccttaatccaattggcttgatcgtaaacttcttcgcggtcgtccagttcccatattgccacaaaataacggtcagcttcggttttcccctttaaaacgtccgtcagcatgtcatattcggcgtgcattggaacgttaaggttaagaccagaggtggaaatcaccgccagcagggagttatcttcttgtgcttgaccagactttaaaacgttgtacactttgcggtctttagcttcgtgccactcatctaaaataacggtcgtcccggcataaccatcaagtgtactggtatcactggcaagggctaaggcttgcgaatcagtttccaagtcagtaatggcttgtttttgcaccttgatccgttgccgcatgtacttcgattgcttgcggacttgccgtaacccacttgaaagcatgtcgtagcccaatttagcttgtttaagggcgttgctgacgaataatacttgtcggttgcgggcgggctggcgttctcttaaaaggccattagcggccatgccagaagctagataggttttaccattcttgcgggccatgctaataaacgcacgatcgtagcgcctattaccagtagttttttcacgccagccatacagctcactaataatccatttttgaaaaggttgcatggtgagttggctaccgtcagtcttaggcattaattcgataaatttgaccgcctgtgccgctttgtcttcgtcgtagtagaacgggaagctagtttccttagaacggctcaaatcgcgtttaaatcgttcacacgcccatttgattttttgaccagccaatacttgacccgataatacttggtcaacatattcaatcatgacaacatcgcctcaaaagtatcttcgggtgtctcatctttttgcttgtttaattccatgcgtgcccggcttgataacgacatgcctaaatcgttggctaaggcttttaaatctttcatagcttgcgactgcaaggccacgtaaggattcggcttacgtacaccagtctcttgattagtttgtactagtccgttcttacgaatatcattctcgcaagtctgtaccgttgcataagcacggcaataactggctaacatagcccgatcaagttcactaattggagtattggcctttaaataaggcgctacccgttgccattcagttaaggcccgatcgtgtaaccaatccggcggggtcaaatcaagcaccggatagtcaaataacgctttctctgcgtctttacgttgatcacgctcatcattggttaaatgtttcttcatgttggctaaggcttttactttttggctcattcggagcactcctttcgtttaaatttacgtaccaaaaagcccccacgagttatacccatagcggctgattgatacatatatccagaattcttttattatacctatattatcgcacatattcctaaaaagtgcaattaataacatgtatatatttacacgttaccccctgactggctatttgtttaaatttcgcattattagtagggatatttcacaatccagcaaaatcagcaaaaaatcaaagttcaaaagggacttttataaacacaaaagtatgctgtccgctcctttcgggtcggccacagccccccatatcaacgtttctgggctgtcatgctgttttgaattagtctcgtggccgaaaattcagccgccaacttggattgctcactcggccgaattttcggcgcagtccattgccaattttggcaacgtagacgcaaaatgcgggttggttaacttggtcgaaaatttcgactcagtagctcggctgaaagttcagcgcagtattgcgcagatctactactgtggaaacaccttttaatatgaatcttgaattgtgggtataaaattgcgactcacaaattgttttctcgctttcacgtgatataattaattttgtaggaatcaattgtagcggagtcagtgatggcggcgtttttatatgttatactgacaacggtcattcgagtggtcctgtgactggtcgccttaacgggcggctttttatttacctaccaagttagtgcgttgaagtcgtaacttgcgaccgcagatactaaaaagcgccgcacctttcagcacgacactcattggttatttagtttgttgttcccgttgttctctaaccaatcccgtttttcggttatggtgtcggtagcacaatggttgtaggttactttcatctaagcgacgtgaccaatcgtctttgatctcaataacgtgatcgaccacatcggctttgcggatcaccccatcttggtaacattgcacgcataccggattactttcaaggaaccgccgtgacaacttgcgccatgccgaagacttgtagaactgctggtacttgctctcgtctgaatcatacatgcgtttatgatagcgccacttgttagtggccttgcggtgcttctcacagtagcgtgtgtcataggcaaccaacgtccgacaacccgggtgctcacattgcttcattggcttagccatgtccgttgaccttagttagtgttacaacatcataggcgttcagttcgccatcagaactaacgccagcaaccttatactcaacaccatctagcaacgctagtagtgctgtggtaatacgttcatcatggcgcaccgcaattagctggttagttgtcgcagtcgtaccagtaaggctaatcgtgttactgatggtcaacgtatactcaccacaccagacagtgaacagtggcacgaattgctgcttggttgtgccgtttattaggttctgaacagacttgacggtgccaaactgtacccgctcattcaggcggcttagattatagttcttcattagttaacctcacttgtaaataatcatggcgcaatattctgcagaagaagaatctaggtctgccccaaacgcgttacttgaaaacttaatgtcaatgacattgtcactatcaatccggttggctaattctctgttaattgctcggtctaaatcttgtacagacatttgcataatcgtttttgttttaatcattatagttagatcctttctatcatgttaatcatctaattgttccaacatcttgtacgcatttttgcgttgttcttcatcgcttaaaggattattcaaaacttggcttgaaacgtttcggataacgtaggcgtcagctaaccaaccttgacttgatttcataaagtgatcgtcactaaattgtgcataaatggggtacatgagttttaagtctcttacagtttctggctcatattctccatcttcatttggggtaaagctcccaaccaatcctttatcttttgctttttgagttggctcaccattttgatctaaagcaccttctttaatcaaggctctgtaaatacacgattttaattcattaactctatttgagacaattggtccatattgtttaacgtaaatgtcaaaagcttgctcaactaaacttggataaattactttcatttttccttttcctcctgtactggaaatgtttgttttaacgtggtccacgtggtcccgtggtccaaacgttgatatatcaatgttttaaagaccccctgacgtggtccatatggtggtccaacgtggtccacttggtaaatttctgattaaacttcgcgcatatacccatgtagacgttggccattcattctaattcgttgacttttccaaccgtccatattgtccattaataacttgattcgcttagcttccgagtttgttcgcccggttaagtaacgatcaactgttttatggaagacaacttccataatttcccgagttgttgtttgattgagtagtttccgttcattactaacttgatcttgtagccacttagattgatggccgtagtcactgacatagctttgttttaagccggtactcatatttccccaatctgtgggaacttccattgctaaaaacgcttcgatggcatctcgcatagggtcgacagcttccgcagccatctgatacgccttagcctctttcatagtggcctgatccagatatagcagttcaccattcctaaaccagtacatggcctccgccaatacttgaagcatgtaattctcgtccgggtgccatacatctaatttggccttgttgaccccacatttaattggataaaaacgccgttcaccggtcgcgtcctttaaatagtcggtttggttagttgtgccaataaatacgcatttacgcgggtgcggtaacgcatagcggccgtaactattccgatatgtgtcggtttgtgcactaataaaatttttaattccctcaacgtccgttttcttcatggcggaaagctcggcaacttcaataatccaactaccttgtaactgttgataatcgtctttctgcttacccattcctttcaacgaatcattgaatttatccgggtatagattcttaccagccgtactcttgccaagtccttggcttccctctaagataggaacaatttcaaacttaactccgggaacataggcccgggcaataagaccagttagccatttcttagtgatggtgcgggtgtaatgattatcttcggcacctaagtaatcaatgaaataacgttcagcacgtggctggccgtcccattctaccgcttcaatacgagccttaaccggattgattgtcttgcggcgtgcctctgtaactaccgcgtcggtaatgttttccttgctgaataacaagttgtaatgatcctcaatataacttctcaataacgtgtcatcactatcattccaaaaaccttttttgaacagtgaattttctgcttgtggtgttttgacaatttgttccgagaactcgtcaaagacaactagccctttcaacatttcgtcatgttccataattaagcggatattgtaaagagactgtgttttaattccatcgtccgaattcttcttgaaatcgttctgccaatcagcgtcacgttgcattttgataacattgttggccgcttctcgggtttctgctggtaaatccattgctttgcccattaatgaacccccttactctctcgttttaaaatggattgaaaaataacattaacttctttgcttggtagtgctggatcaacgaacgaatcattgattactgacagcatgttatagactgtcttgggatcagcaccgacgccaaacatacgaccggcaattttagttaaccaagcattgcgattgccttgggttgttccggttaccatttcatctaacaagcgaccggtatacttctttaagcgcgttgtataggtgtgttctgacgcccagttcactttttgccccgccaacttatcaactagccattgaggagccggcttaatatcagccaatgttcgaccgtctaaaggttcatacattttgccgttaatttcacttggtgcaatcaccgtgaagtcacttaacaagtcaataccgggccaaacgtcaactttgcgaaccttagcgcccgcgtatttcaaaaagtaatgtacgccgccattagccgtccgttcaatgtaggtatcactcggcaacgtctgtccttgcttaaatagttgtgtcaagctggcccgaccgtttttagttggatcgtgcatatcaacatcaacaaccaataaatccgataaatctaggcgcaagcctaagttgtaagtcgggtgtttttcaaaccatgtgaagatggcgccctggtcaatagttgcggcttggtagccggccacccctttaggtggtttcttcgtattctcaatcagtgggtaaaccgcatagccttgttgggccagctcaatggctttatcgagtgttgcgaattctctcatttttcaacaccgcctaatcttcgggacaaatgccattgctaactgccataatcgaatcagcaacattttgcatgttttcaacaacgtttccagcgcggtggtttgagaaaaataattgtcctgcccatgtgtccccactattaactgacgcagataccatatctaagtaatcaattgccatttgcagattgtcacgtgccgttgctaatttttcagcttgttccattaattcactatttgtcattttccattctccttattcgtgttaaaataagggaaagcatattttgattaattcttcgacctactactcgccaaagtaaagtaggtcttttttgtatgctttcccatgcaactgacctcacattccaaaataccgacgtgggttcttgattaacttaaccaccacgttgccgacaaacgacacaatcataaatttgattacccataagattgctgttgctatcatgaaatcacctccttaaaattattctgcccccgcacggtacaattaaattttatgtgcttccatgaacttatcagcgtctagttggtcaatacgttttgtaccgttgattgcaactactcgtaaaccctgaccaatgtatttgtacagcgtgttatatgatttgatattcaagcactccatggcttgcttatatgtcatatatcttggaaaactatttttcatattcatcattttttctccttaaccaaatttctaacttacaatatgtttgcgtagtaacttcgctttttcgactatttaatatgtctgaaagtgtccatctattaacaccgctcgaaattgacattttttttactgtgtccattccctttgctttgaccagtgacatgcgaaacggttttgtgatcttcatcatatactaccctcctgactagcaactttttgttgacaaaatatattatacgcaactttacgttgcagtcaacaaaaagttgcactatgttactaaaaactgtaaaatattcctgtattaggaagtgattagacaatgaataaaataaaagaactacgtcaatatatggggctttcacaagcagaacttgctgaaaaattgaatgtaactcggcaatctataagcctatatgaaaaaggtcaaagagttccacgtattaatgttttgaagaatatggaagccatttttggcgtgccgataagttatattcaaggccaggcgacgtatttatcacctatagataaggctaatcttgtttcacaaaaaattaagtttggaaaagatgagcaactctctgtactaaccaaagttcttgatgattcaaaaaaagatgacgttcaaaaactaaagaaacaacttaacgatcttgacaaaattattgataccctttctgacactacaatcaaaagcttatatacatcagttaattttttgcttgagctagatcagtctgatgactcactactacagcaagcatatttttctctaatttcaaaattagaactagctttgaattcaaaaacggaaatatcaagaaaatttgcagagcatatatttaaagatttttttaatcgtttgaaagaatttagctataaaaaataattttccatacataacactgcccccgcacggtacgttatggaggaaattataaatggcaacaatcaagaagtatcaggacaaggacgggaatacccgttatcagtttcaagtttatttaggcgttgatccactaacgggaaaaaagaaaaatacccgacgccgtggattcaagacaaaaaaagaagcccagattgtattatcaagacttgaacttgatatttacaatcatggactaccgactaaaaacgataatacaatttttaaggatatttacctactgtggttcacgcaatataaacaaacggttaaggaaagcacttgggtaacgactcaacggctgttccgacttcatattttaccaatatttagtgattaccggattgctaaaatatccattaaggattgccaaaaagccattaatcagtggtttaatgctggcttggccaagtatcatactctaatgaattacgttgccaaggtgcttgattatgccatcaacattgacttgatcagtgagaatccagccaagcgcgttattgtgccagtaaataaaaatgatcgttcacgcaaaaatttagaaaattactttgataaggctgaattacaacacttctttgagtgtctgaatgatgatgacaatacaccgcaagccagtgtattctttcgtttagcggcctttactggtatgagaaaatctgaaatgctttgcttagaatggtatgacattgattttagcaaccacactatacgggttaataaaacacaatcccgtggtgatggtgcccgtctgctagtacaagcgcctaagacagcgcgtagcaatcggacagtgtatttagatcccactacgatcaaaatattgcaacgctggcaagctgatcaaaaagaatggctactacgtttcggattcaatattaatcagggtaaccactatgtgtttgccaatgaaaataacgaaatgtttcaaccatctaagccacgtaaatggcttgaacatactctaactaaatatgacttgaagcatgtcacggttcacgcattccgccacacttatgcgacacttgcatttgaagcccatgcttccatcaagtcagtacaagaccagttaggacattcaagctatcgcacaactttagatatttacaccgcagttactgccaagcaaaaaaatgaggccaccgaaaaactggctaattaccttaatttttaatatttaggctgctaaatttgacgtattttaccaagtggaccacgttggaccaccatatggaccacgtcagggggtctttaaaacgttgatatatcaatgtttggaccaccggaccacgtggaccacgttaaaacaaacatttccagtacaggaggaaacagggttaatttaatggtagtcagccaaaaggacagccaactcaatttcttaaaggcctgaacgcctcataatagctggtatacaagcatttttggtgatatgggggtcgttcccagtatacccaatcagaagtacggataaagccacgcaggtaagatcaaatttacctgcgtggctttttatgaattgtcacacccttgccagtgcaattttatcttttttcactcaaaacggtttacggacttgattaggggtttataatagatagtgtagactgtctgtgaagccttgtaaaattgtcactattttaaatttcaatccaaaggagataatgttgttggtatacaaagatgtttttggtatcgatcacaatgattgtcacattgttcagacgcggcacgagtttaaccggatcttcattatcgaaaatgaagttggctctcgctttacttgcatcaaagatgatgccccactcgaaaagaagatgtctgggcactggaagtatgcaaaagctagcgacgcccctaagaactatgccgttccttataaggcccagaaaaactaaacaaccgttgaaaagaggattacgatgcggcgctatcaaccgttaaccaaatcaaatggccgggtcccccactcgctcaatcataacaccaacccctactatggtcagcatggtgctgattgggtcaaagacacgaatgcttcgctatttaatgtccaacatgagcatctccaatcaaagagccatgttgagcgacgcgtgcggcacaacgtccgtcaagtgctgtgggtggtcgtggcgattcttgccatgttacttggtggttttatcttgttctcattagcgatcaatatttaacactaaaaagagtcattcagcttatacaagttgaatgactcttttttactagcctttaatttccttggtatccactaaaactttgctgaccatccgaagctcatcagttaattcagaggttcgaatccggccaaattcgtcgaggaacttgccaaggcgttcttcgttaactttttcaatgacccgtgctaacttctcacctttggcggttaacgttagataacggtaccgacgatcataaggatcgatgttcaacacaatcaagtcattgttgatcaagtaggtcagtttccttgaaatcgctgaagaagagacgtggcggtcagcggctagctctttcaccgtaatccggtgatcagtgctatggtcaagatagtagagaatcaagaactgttcgaacgacacgtccgcatcagtcaccatcgtttgaataatctcgcgaagatggctttcaagccatgacatgcccactaagactttttcgaacaattccgcatcgtcgtacttggccttcttagtattagtcttcatcattatttaaaaccccattcatgcgtcacgttcaaggcatcatcaacaaccccgtgattacgcacggacttctgcagctggcataacggtgatttcaagatcacgtgtcatttgtttctcaatcgcagtctgaacatcacgatccgttacaactaagctcgacaacttactctttccgttgataatatcttggacgtgttgattatccaaatcatcagcagagacgattggtaagagatggaaattatcattcgttgcttgtaagcattggtcgaacaatggggcgttaactcccataaccaacacactgttttgttgttgcaagactgatgccaaccaccagttcaataattgtgcttcagaatggaagacattcgtgatggcttcttccttgttcactaattgaattgataattcgtggttactaccatattgcttgaccattgctaaagagtggtctggacgatagaagttttctagtgtcacttgtgagttattcgtccggtcaaggtactgagtgactgacaagaacccggcagcatcgtacacatcccgacgagttgctaatgacccattgaagtaagtcatgtaccaaatggcaccattcttacggtacttcaacgtcataattgggttaccgccgtcatcggcaattgacacaatctgcttatcagcattgcgcttatattgccatgcaggattatcaggtaattctggtttagtcttcgcaacggcacccggtacctttgcctgaatcgtgtagtacatgttgtacaagccagttcgtttatcaactaagccagctgattggtaactgttccaaatttctggcaagctgtcattatagttaaccgtaataacattagctttatccttaacttcactcttcaataagcccatgatcatttccatcgaagccttttcatcaccagacaatgactgaatcaaatcggtgctgaacaagaagtactttgcagactggtcaaattcgacgggcgatactaagtgagtcgtcccgtaatccgattttaacttggcatcaatgctttcaatcttttgttggagccccttaacaatcgtagcattttgatcataatcatgttgtaatcgattgattttctgattaatcaagttgagtgaacgttcttgttcgtcttgagcactcttcttcttacgatcataagcaactaacgcatcttgagcggtatgtaagtctttttccgcactcgtaatcgcgtgttccttccgcgaacgttcacgggtttcagtctgttcacgcttctggagtttcacgagttcactgttgattgcgtcactcttttgatacagatcctgtgcttgcttctcctgttgcttcatcaacacgaataacttcttaagatcctgttcgccctgaattgctttacgcatatcagcttcattttgcttcaaatcagctaatgattgttcagactgcgtaatcttcttttccaacgatttgatggtttgatcgctcttagcaagagctttcttagcatcatcataacgtttttgagcagcattgatggtcttgaccattccctgccgttcgctatcgttcgtgttaacgactttgtcctgtttagacagagtaaccttagcgtcctttaactgttgttctaagtttaactgttcggcaactaaagtttcatactgttgcttttcgtgcttacggtcctgaaccaattggaccttaagctccccacgtaaagtttggtattgcttgtttaagtcagccatttcgcgttcaattgccacactgtttttggctgctgtttgggtagcacgccgttggttgacccggttttggcccttaactggggcactagttgaagcagtcacgctgctactagttggccggacaccagcagatgaccgcacattgggggtcgtactactttgagtcgcctttggttttggcttttgagcagcaacggttgaagtcgccgttgcacgctcagaatgattacggtaatcctcattcttatctctgcgctttttattgaacatcttcataatgcaactcctccataaacttgattgtttgctcaaagagtagaaaggtcatcgctgacctttctatccgttcagcaaataatcaagctattctaattattatgcttcatgcttccgacgagaaacgccaaagtatagcgctgaacccatcaataaggttgaaagacccaagacagccaaggcagtcccgttttcgtcttcatccgtttgtggtaacgtctttgcgtctgaagtcgtcgtcttagtcgtaactactggcttcaatgaggctgatgcaggaacaaccccactagtcccattgttagtagtagccgtcgtcgttggcgttacttcatcatcagaaaccgtggttgctggtgcggttgaagtagtcgtcgttgatgaaccgttgtttgacgagccattaccattatcaacagtattgtcacctggcgtcgtaacaggagcagttgtagttgtaccagtaccgccaccgttgacgttgtcaccagtgccaggtgcagtcgtaggtgcagttgtcgtcgtgccaccaccgttactaccattgtcgccggtaccaggtgcggtggtaggtgcagtcgttgagccgccgttatcattcttagcataagttaaggtgatcgtcgcgtcatcagccaccgtaccactcaaagcaccatcagctgacttgtaagtgtaaccatcgattgttggcgttgcgaccgcgtaagtgtccccaactttgtaagttgtggtcgtcgcactcttgatcgtattaccatctgcgtcaacatagttaactgtgatcgtcttagtttgttcagttggagtagtgccaccgttcttcgtgtaaacaagggtaactgtgttacccttgtaggcaatcgtcccggcaatggcatcaccagtagcatggtcataagtgtaacccgcaatttctggttgaccaacagtgtaagcttgaccaacaatatattcagttacgttggatgctttgatagtgttaccatcagcatcaacataattaatcgtcaagttagctttgttttcaactggtgtcgttgaatccttggtgtaagttaaagtaatggtcttattaccatcaaccgtaccagttaaggctgcatcagctgacttgtaggtgtaaccatcgatcgttggcgtttcaactttataagttgagccgttatccaaagtttgggtagtagctgtcttgatcgtcttaccatcggcatcaacgtagtttaccgtgattgttgattgttcaactggggccgcattcttggtgtaagttaaggtaatcgtcttattaccatcaaccataccagtcaaagcaccatcagctgacttgtaagtgtaaccatcgattgttggcgttgcaaccgtataagttgagccgttatccaaagtttgggtcgtagcggccttgattgtgttaccagattcatcaacgtagtttacagtaacatcggattgttcaacaactggtgcataaacaaaggttactgtattagcaccagcaacaagcgtaccagcagcaacattgccggattgaacatcgccgtcaccaatcttgtagcctacgtaggtatagccatcaagacttggagccgtcaatgcgtaagtaccaccagcacgggtaaaggttttgtcagtaccttgagtatattggttaggcgtagccaacgttgtcccatcagcagtctgatagttagcaacaataccagtattttcggcgtagaccaatacaatttcattattagtagcaaccgaatcgactgtaccagttaagccattgtcaccaggtttaacgttattgcttgcgccataaagggcatagccatcaattgttgctgggctaattgtaaaggtagttccaacctttccactcttagttacaccaccagcgatctgagtatacttagggataccatctgcattaaagccagtgatcacaacgtatgccaccgaaacatcctgtgcatcttcagctggtgtggtagttgttacatcagtagttgtctgagcagtgtagtcccacccgttctgatacaagactgtatttcccgccgcttcaatatgagctttatcatcagcatttggaatatcgttgattgataaataatcactatttgaattagtatcattagtagccgtatattcatagttaaacgttaacgtggtcgcgttaataacatccttaaccggaactacgatagtgctaccagtaccaatagtcactggggtgttctgattgatttgatatgaaacagccttccaagttccgttcgccgtttcagaactacctgcaggagcaattgagaattgtccgttagttctacccgtattccagtcaattgccttgttcttggtaagcacgacctgcatatcgtatgtttgcccttgacggtcttggcaaccgttgtgccatcgactttcacattgttggcattaacatcatgactagcagctaacgacccactaccagtagcaactgttgaagttgcttcagaagttgttaaagttgcttcactagtaacctttggcgttgcactagaggtcggtgcagtaactgttggtgttgcctgttgaacagtcacggttgtatcaacactagcggctcgtgactgaaccttagcagaagttgcaacagcggtttgcgttgtatcattttgactggcaacagaactggcagcacttgttgttgaagtagcactctgtgttgcagcagaaactgttgaagttgattgactagtcgtagaagttgcttggctagtcgaagatgcagaactggcatccgaagtagccgcttgactagttgctgatgaactggctccactagtaacttgttccgttttagtttcatttgctggtgttgtatcagcagatgcattgacgttggcaaatactaggccggcagctaaagctaacgtagttgcaccagcgcagacccagtgtttaccgtctttatacatctttacccgataaattgaatcaccggtcactttttgattatcttttgacatatggattcctccccaagcactcacgatttttttggcctcatgtaaaatgatgggtgacaaatcgcttgccagcccatcatcttagtcacgcgtctatcgtattgtgcttattacaccataaatggttttgttggcatttcagttttaaataacgtattagcccttaatggctttgattacgttcaagataaaactgtgtaagccaccaaagatgtcatttgaaacacttgatgaatacgatgatgtgtgtgttcctggtaaaatatgaaaatcattgaaaaagctcatgatctattccccttttaattggttaattaattagcctttaatagctgcaattacgttcagtacgaattgataaaaagtacccaatggttggttgcttgcataactcgtatgcgttgcagtatgtgtacctggtaagaaatgcaaatcagaaaagaaactcataatacatatcctcctctattatctagataatatcaagtcattaatcaattaattgattaatatatctgttcgatcgattagcccttgattgctttgatcaagtttaagataaagctgtggaatccaccaaagatatcattcgaaacacttgatgaatatgatgatgtatgggtacctggtaatacgtgaaaatcgttaaagaaactcattgtaaaatcctcctattggttaactgtaattatttgctgaacaaactcttgattgctggaatcaagtttaagatgaaactgtgtaatccaccaaagatgtcgtttgaaacacttgatgaatatgatgacgtatgcgtacctggtaatacgtggaaatcgttaaagaaactcattgtgaaatcctcctataaaattaactatgattatttgctgaacaaactcttgattgctggaatcaagtttaagatgaaactgtggaaaccaccgaagatgtcgtttgaaacacttgatgaatatgatgatgtatgggtacctggtaatacgtgaaaatcgttaaagaaactcattgtgaaatcctcctatatgattgactgtgattatttgctgaacaagctcttgattgctggaatcaagtttaagatgaaactgtggaagccaccgaagatatcgtttgaaacacttgatgtgtatgatgacgtatgcgtacctggtaatacgtggaaatcgttaaagaaactcatgttgaaatcctcctataaaattaactatgattatttgctaaacaaactcttgattgcaggaatcaagtttaagatgaaactgtggaaaccaccgaagatgtcgtttgaaacacttgatgaatatgatgatgtatgggtacctggtaatacgtgaaaatcgttaaagaaactcattgtgaaatcctcctatatgattgactgtgattatttgctgaacaagctcttgattgctggaatcaagtttaagatgaaactgtggaagccaccgaagatatcgtttgaaacacttgatgtgtatgatgacgtatgcgtacctggtaatacgtggaaatcgttaaagaaactcatgttgaaatcctcctataaaattaactatgattatttgctaaacaaactcttgattgcaggaatcaagtttaagatgaagctgtggaagccaccgaagatgtcatttgaaacacttgatgtgtatgatgacgtgtgggttcccggtaagaagtgcaaatcagtaaagaaactcatgaataactcctccttttaagttagttaatggttaaatccccaagcctagccacttgtatggcaagacttgagagtttggaaaacaaattaaattccgacaaacttgattaaacggttagaaaattcaactaattaatcattgaattccctaacacccgtctctagcaacgcttaacctttgattgcggcaatcacgttcaacacaaactgatagaaagtaccaagtggttggttgctgacataactagtatgtgatgatgtgtgggtccctggtaagagatgtaaatcactgaagaaactcatgttaatatcctccttagaaaatttacaaattgttcacaaattagcagctcaataatcattaatttaatttagtctgttaaataactaatattgattactaatgcgaacgtgaaacaagtaacctcgtttacgatttaaatattaactaattcgccccacaatcgtcaataaaattactaatatttgaataaatacagggcagtatcatattcaatcagtaaatgtgtatactatggacaacttacgcgtttcattaacggtcaaaatttgtgtccaatatcaatattatttatatttatcaccagttaactatgccaacaaaaagcgtttaaacccctgataatatcagcatttcagcgtagttgcttggtgcgacatcccctctttttttccgaattatgaaccataccatcgggaaatttattccctaaaaaataattataaatatcgcttttttcgacttattattaaaattattaatactttggtagattgtaaaattaatccgaacgctgttcggacaaaaaagatcagcttcctttaaaatggtgtttaccacaaacacatcttttaggagctgatcttttgtctagtataacctattctgaacgaattaaaatcgaaaccttttgtgaactaggcctgtccaatatccaaatgagcgatcgcctaaaacgatcacctgccacaatttcttatgaattagctcgatgtgaaccttaccaggccgaagtggcccaaacagatgccgaatacaagcggtcacgatgtggccgaaagactaaattgaatgacaaattaaggcaaataattttaaaccatttacggctaagttggtcaccagaaatgatagctcacgaatttaaactagcgactaaatcaatttataattggttaaatcaagggaaaattgagttttctttaaatgatttgcctgaacatggcgtgcgccaacggcgtaaccttgaccaacgttctaaatataatcaatcattaggacggtcaattgaacagcgacccatcgtggttaatcgacgtaatcgcatcggtgattttgaattagatacaattgttggcccccgtgggcatagtaaggcagttttattaaccttaatcgatcgcaaatcacgtttcctttgggcctaccgattaaaaaaccggacagcaggaactgttaatgaagccctaaataagtttctagcaacttttaatggcccggtgcatagttttacggtggaccgtggcactgagtttagcggtctagtatcacttgaagcacaatacggtattaagacctattactgccatgcttatacgccagctgagcgcggcagtaatgaacgatttaatcggaacttacgctatttttatcctaaggggacttattttgagcacattagtgctcaaggcttgaaaaccaccttactcgaaattaatcagagaccacttaaaatacttgactggcaaacaccttatcaggtcatgctgacaaatttgtccaaaaattcggattaaatttgcaatctaccctttttatattttttacggcggttttatttcatgccttaacccgcgttatccagttgaatacatattttgggatcaaaaaagtggctattgccaacactcagcaataaccacttactaattttaataatcaaacaatatttcactaaggcctttttaaccgtgttgatactgcagccgataaaagtcacgataacgttcatgggttgctaataaggactcatgattgccatcacccgtaatctgaccatcctccatgaagagaattcgcggataagcttcgatctggtttaaccgatggacaatcgtaatagtcgtcaggtcagctggtaacgtcgccaagagctgggtcacccgttcttggttctgattatcaagactagccgtcgcttcgtctaaaatcaataacgacgggtggcggacgagtgcccggacgatggccaaacgttgccgctgcccaccagaaacattcaagccccgttcaccgacgtccgtatcaagaccagctgacagttcagctagccagtccgctaagccgacttgtgtcaacaacgcactcaattgttcatcagagaccggttccgtcgaacctaacaggagattatcgcgaatcgtcccgggcatcaagtctacttcttgactcacgtagccgatctgattacgaatcgagggaatcgtataactggccattgtctcgccattcacgtccagctcaccacgagttggcgtatagtaagcttctaagagcgaaactaaggtcgttttcccgctaccactctcaccaatcaaggcaatccgctcaccgcgatgaattgtcaaatcaatgtccttaagcaccggtttatcactttcgtagccaaaatcgacgtgatcaaagtcgaccgtatcgattgttgacagcgtttcgcctgacaaccgcttatcttcttccggactatctaaaatgttgtcgattcgctcagttgccccgaccgtttgttgcaaggcagtcactaagccagttacgctactcagtggtgaaatcatttgaacggcatacattaagaaagctactaaacttccaattgtcaacgcgttcgtttgtaccaagatcccaccataaacaatgataatgaaaattgcggccagtaacatgatgtttagcactggattaagcaccgagatcagcttgatttgacggacactgaagcctttgatccgatcaacttgatcttttccctgttttttcagtgccttttcagcaaccattgctttcactaaccgattttgaccaatcatttgtactgctgcactatttaagttggccgtttctttttgaatcgctttggagatccgcgctaacacttgacccattggcacaatgatcacggccatcaatggaaccacaattaaaataataatcgttaagcggaagtttaataacaacattaacgtcaaggaacccacaattgagatgatcccattaatggcattcgaaaactgacttgaaatcaattcaaaaatcgtcgatgtatcgttaactacccgactagacagttcccccgtccggttatggtcaaaatacggaatcggcaagtccacgatatgttgccataacgcgctccgcaacgtcgaaacggcgtcgacccccgtataactaagtagaaaactcgacgcaacacttgcaaatagctgcacgacaatcacagcgcctaaccgaagcaacagttgacccgaagtaccatggttaaaggcgtcgataaactccttcaacatcaacgtaatgccaagactacaaatcgttgcgacaaacgacaacaggattccaatcacaaagagtcccttcttcgggtgagcatgggtcatgatcaatctcaataaatcacgggtcccatacttggcatgtggttgtttagccgatgacgtgatatgcgtttccattggttgtaactcccctcattgcttgaatatcaggctgaatgacatgatcattccaccgttgccggaccatacttaatgtcataggcaaccaccggaacgccatgacttaacccttctaaaatacctaagttaaagccctcatattggctagtaaggaccatcagttgtgcttggttatagaccggtgtcaaatcgcgctcaaagcccttaaacgtgataaatgactgccaacgttgcgaactgaccaaggctcgcaaccgattttcttctttaaatccagtccatgaatcaccataaccataaatatctaaggtcacattcgactgtttttcatgaacataggcgaccgccttaatcaattgttccaaatttttctctgccgataagcgagcaacggcaatcaccttgccctcaatccgatccttaaagtcaaccggacgagctgctaattgttcgtcacttacactaccaactggaatcgctaaagttggaatcacattatgaatgtggctcgtcatatcatcacactcttcttgcgtggacatgatcaaaccagccatttgactggcgtgatctaacccgatttgagtgtacggcacaattggtgagttcacaacgtcaagtgggtccagcgtgaaattactgtgtaagaactcatacttgcgcgctgctgtggacattttaacaatcggattcatcccagcatcactacgatccacgatcatggttccgtgaccgccatactcagtatttaacgcgtctaagaaaaaggcagtcagctgatcccagtcctcaaattcgtaattatgcccgtgatagtttaacagccgttgatgagtggcaactggttgttgcttctcatttggccggaaaaacgtctctaagacaggctgttgttgtaaattacagtgttgctctaacacaatattctgcttgtcatcaaagtactgggccaccgttaagaagccccgcgtatcataatagtctcgacggctgaccgcgccctgtggattgagaatatcgacgtaatcaatattcccctgcgcatttaacatcagtgctttttgccgttgttcccgttgaatgacgtcagattcattagcgctgacccgttccagcgtttcacccgtcacccgtggataattggccgcagttaacggttcgccttcgtaattcgtagtgccttgaaaataatcatacatattgacctggaactcatcatcatacccaatgagttgcatattatgatgtaaatcgcgtacaaagttacgggtcacgatcaacgcaggtacccggtgctttgtgaataatttttgacgctgaatcatggctaactcaatagctgatggcgtcgaatcaattttgctcgtaataaagaaatacatttgctacgcccccgcttttattcatgtgataaactctcgactggatccaaccgtgccgccatatgtgccggtgccaaagcagccaataaaatgatgacaacactgactgtaatgccgcccagcattgctgccccggagattcgaacgattggatacttaattaagctatagatggccatattgcctaagaattgccaaccttctccaaacagtaaccccataacggcggctaataccccgatagttaaggcctcagcaaagaacaaatgactaatatcgcgtttgcgggcgccaagtgcgcgcaaaaccccaatttcacgagtccgttcagaaacgctgacgtacaggacaacaatgatcataattgctgagactaataacgcaataccagccaccccggtcaatacgttagtggctaaacgaatataggtattcaatgaatcaattaaatcaccgattccggtatagttatactgttgcttcttattcgttcccttgatggccttgatttggtgttcgacttgcttaacattcgccaatttatctatttgaacaatggcaaaatttggtcgataagccacattcttagcagttaacatctttttgacggtttgtggtaagaccacgacgctagtatcatcgctacccgtaattccgctgacggtcagcgtctgactgaccgttacggactgattcttgcgattaaccgttgccaatttaacggtcaacttcttattgagcgcttgttgataatttttcttacccaccatcttcttagctaacttacgaccaatcaaaacttgaccattttcaggacgtgaaccgtccttaattgtcttactcaaaactgtggggttatccgtctggagactggccgtcacggttgtttttttataactcgcttgtgtgctcgcgtaatagcccagcttagcagacttaacatgtttgatagccgctaattgtttgacgtttgcagtcgtcacttcggcattcttcgcggctgtgacttgttcttggttaaccgctgctttgtaagctgctgcactggttgcttttttacgcgcagccgtgctgactttccccgtcttctttgatacttggacagcggttggattaacttgagacgtaatctggtgattcatatacttttgaatccctgatcccaagcccagcattacaacgatactactgatcccgatcgacgatccaaagataatcagcaggtaacgaagccacattcgacgcatatgttgcatggacatccggaacatctgccgaaagccaagtgttcggtaacgcgtcggttgcttatcgaccacgtcgaaaggcgacccgatcactaattcgtcatgaatctggccgtcatccaaatgaacgatccgcgtcccgtagtcagccacttcctgcgaatgggtcacggtgatcacaagtttaccttccgcagcgattgagtataaaatatccattacttcttgggtattttcactatccaacgccccggtcggctcatctgcgataataatatcggggtcactggctagtgcacgagcgatggcgacccgttgcttttgaccaccggatagttcatttggatactggtgcgtctgctgctcaagtcccacccgtttgagtaggtcctgcgcttgctggacttgttgcgcatgggacgtcttagtcatctttaatgaaagcatgacgttatccaagacagttaggtaacttaccaagttaaagttctgaaagataaacccgattgtctcccgacgataccggtccatttgccgcacattcattgaacgcaaggattggccgtctaacaagacatctccatcataatgatgatccaagccaccaataatattcattaacgttgacttaccaccaccagactccccaagaatggaaataaactccccccgttcgaagtttagattaatgcccttcaagatgacattctcttggtgatttaaggtataggccttacgaatatcgtgtaattctaaaaagctcatatatgtacctccactattttattaactacattccccacaatgtatttcctcattaataacattgcgatttttggtgaatgatgtaaagtgttattgaatacctgtggtcatcattcataattaaaattataatcatcctaaatcctaataaaccgcctacttggtagttacaatttgtaaaatatcacccattttgctgatttttacaataaaattttttctatttcgaacttattttatgacggcaatcacgacttaaccgtcagcagagataaatccaagcaccccacacattcaaggcatgaactaaaaagcgtccattactaggcacactgactgccagtaacggacgcttcatcgtattaaattacacctaatgactccaacttcaatcagcaggattcctacttaaaaaaggaccgcttcgtgaccacgcggtaaatcgcatccgctaaaccagtcacaaatacgacaatcagccctgcaaattgcaaccatggcaattgttgcctgattactgtcacttcactccccagccaaaagactagtaacccgagaacaataatgatactttcgataatgtttaatttacgcatctcaaactcctcacgtacatcacacatcgttgcgagcaactaccatgcatgactatatttgtcctttaacacctaatctattataacccgtctgctgttaaatcacatgccaaccactcacgattaaactcgagataggtcggcagatttttcattgcgtgatgtcattcaaagttagtgcgaccagtgcggtcaaaaattacaagcgtcaccatgttaaattagggtcatcttgcggacgtagcgattcatttcgccaacaacgttgtgattcataaattttagattagcgacgacgctcaataacagctacgaacacagcgtcagaaagacaagcaaaaagcccccaaaacaagcagcctatcagccagctgatagttgtttgttttaggagcttccatcttaatttctaaagtgctagcaccttagtcactaagacgtgcggttaacttcttagttaattcttcgtaaccaggcttgccaagtaaggcgaacatgttgttcttgtaagcttcaacaccaggttggttgaatgggttgatcccgttcaagtaaccagaaatggcaactgcagcttcaaagaagtacatcgtgtaacctaacgtataggcatcctgtgaaggaatgttaacgaccatgttaggaacaccgccatcaacatgggccataataaccccttcgaaagctttggtgttaacttgagccatcgtcttgccttcaagatacttcaacccatcaaggttttcggtttccttaggaatgtcaacgtcactagtagcgttgtcaactttaacgaccgtttccatcaagttacgacggccttcttggatatattgacccaatgagtgtaagtcagtcgtaaagttagctgatgatgggtagattcccttttggtctttcccttcagattcacccattaattgcttccaccattctgagaacatcgccatgtttggttcgtagttttcaagaatttcagtggtgtagcccttccggtacaagatgttccggtaagcagcgtattggtaagcttcgttcttagataaatcggcatctttgtattcattttgggcatccgcggcacccttcattaatgaatcgatgtcgccgcctgataccgcaattggtaataaaccaactggtgtcaaaacagtgaaacgaccaccaacatcatcaggaataacaaaggtttcgtagccttcagcgtcagcttcttgcttcaacgcaccgcgcttgcggtcagttgtagcatagatccggcccttagcagcttcttcaccatacttcgcgattaaacgttccttgaagacccggaatgcgattgaaggttccgtcgtagtccctgacttcgaaatgatgttaacagagaagtcacggtcgccgattaagtgaattaagtcgttgacgtatgaagatgagattgagttcccagcaaagacaacttgtgggaatttacggtcttcacgtgaaagtgatgaccagaaagtttcgtgtaagaattcaatggctgcccgtgcaccgaggtatgaaccaccaatcccgattacaacgaggacgtctgaatcgtcttgaatcttctttgcagcggttttaatccgtgcaaattcttccttatcgtaatctgttggtaaatttaaccagccgcggaaatcattaccggcgccggttccttcacgcagctccttatcagcagctgtgaccatagcttgcatttcgccaagttcgttatcatggacgaacttagttaaattagagctgtcaaatgaaatgtgtgccatttactattacctctttctatacgtatttacatgtcatattatacaatagctcgcctaataatgaaaagcgcttcctcccttttttcgtaaattttcgtcatttgtgtaaaaaataaatacaattattaacaaaaaaggtgctgataacttaccgttaccgcaccttcaacagatttttttaatctgtaaatcaaataattaattttttagtaaagctttactaagccttcattaaggataacgcgaccccaccaacaatgaccaggatcgagccaatcaccacgtaaaccatttctcgcttcgtcttgtgctctcctaagaggtagatactcccaaacgtcgaaataacaattcccatttgcgaaagggagtatgcgacagcttgtccgatttgggccattgccataaacatgaagagattcccaataccccagaccagaccagtgacgatattacgataagttgctttaacaacccatggcttatccttaaaggaccagatcaaagcacccagcaacatcccaacagcttgaggcattacaactgcctgtgcattgacgttaccataatggaccacaatcgtatagccagcgtatccaatcgttgataagatcaaggcacgaatcccaacaccccaattttcagaagcactgcggttcggatcagtcttatcagttaaggaagttaaaacagccccggcaatcaacacaattacagaagcggagccaatccaatacatgtttccgtgccattcattgaataacagcacaccggccaacgcattagcaaccagttgcatcccagttgaaatcggcgtagtccgtgaaataccaaccgccttcattgacgtaaattgttgaccttgaccaatactccagaataacccagagacaatcccaatcaaccaaattttgcttgttaaagttggctgttctacggcccagagtgccaagccaaataccaaggctcccatggtcatcccaagggtctgttgccgagcggtaccgcccattcggccactaattaagccgatactgccccacgcaatcgcaggaatcagtgcaattagaattcccattactaataatcctcatttctatgttttctctcttgcctaacgacaaggaattattttaccagttaagtaaccgttttaccagtcacaatcagggattcagggttaaatataattatttttatattttcatgaattcgttttcttagtgatagggaccgttttcaattaatgaaaacggtccccgaaataccctttaaaatttttttctattccacttaaattatggcgcacacactacttatcgagtgtcaaaaccagaaccttcaaatagttgcttgccaagtaagccttgcgcgtcacgaagtctgctggtaaccggaacgtctcactaagtgtgaagtgccgatcactgccgacaaaggccgccgtgaccgcggctttaaacttcttcattgaaaaattattcgcagtcgttgcaatcactaattgcccatcacgccgaacaactggtaaggtcgctgtcaataagtcagttaaatcagttgcaacttggaacttctgctttttcacccgcgcaaaagtcggtgccgttacgacaacaacgtcataacttagtcggtgcttctgggcgtaatctagatagctgttcacttcgattgctcgaatttcctgcttatcagggtcaatattattgaccgccaattgatcagcggtctctttggcacccttcttacttgtttcaatggaaatcgtcttggcagcacccgcaacggcagcagcagccgtaaccccattttcctggctaaacaagttcaagaccgtcttaccttgcaactcggctccggccaaccattcccggatgggacgcatatctaatagtaacccggtcgttaaatcatcagcaaggtgtaatggatacgtcaccgcgccttcagtcactaataacggctctggtgctgcttcacccgtgacgagttgactctttaagttagcttcttcgacattaaatcgtaatttcgcatagatgcctttaaattgatgttcagtagccgcttcaaaagccgcatagatcatttcgcgttgctggtaaacaccttgtgcgtaccatgtaaagacatagtaatcttgataacgatcgattgttaacccgccgagaccgtcgccatccgcattgaagacccgttgtggtaactgtggatccatgctcgttgctcgccggaccaacgcctgtttgaataacttacgaaagtaatcggtcgttggcgtctcactttcatccaagctcaagacccagcctagttgccgacgatgcttcgcaatcagcgcgtagcccataaattgagaacttgccattaacgccacaaaagagccatcggttagtttcatactcggatccttgagatcatcttgtacgagtaaaggatagccgtccttgactttacgttgcgaatttcccgtaatttgtactctttgcatagttgttgtttctcctattcatttcaaatcttatctaaactattgataaatcgctgtttgcagccttgttaagggtaacatatttagcctcagagtgcgaggtagaacagtgtcaatcgctgaaaagtattaggcttaaggtccgcaatcgattactattaaacgtccgttcctactattaatgatgggttattgctatggcccaccgttaccccgcattagcaaaaccgggcctcgagatcattatgatccccaagcccggtccgtacggatttacccgctttaaactatcacgttaatcatcaataatcggtttatcaaaaccttcatctgggaaagtaacggtaaagcacgtcccttcgttctccacactgtcaaccttgatcgaaccaccatgttgttggactaattgatgtgaaatcgctagccctaaacctgattcaccatacttcgtattctttcgtgatgggtcagccttataataccgttcccaaatatttttgacttggtccggtgtcatcccaatcccatggtcttgaatcgcgacaaccgtcgcatgatccgtacggctacccgttacttcgatcacgttagcttgtgaaaactgaatggcattctgcatgatgttaaacaagacctgaacaaagcgatcataatcggcccatactggcagtttctcgggaaccgtcagcttgaattcatcatccgcggcggccgctttctttgtgagctgttcaactaagttatgcaaaacctcggcgccatcaaaattggtcttgttcaaagcaatctgtccggttcgaattttttcgtaatccaagttctcattgactagtcgaatcaaccgtttcgtctcattttgcatcagttcaattgaatgacccttgtcttcttctggaatagcatcgtacgctaacccttccaaaataccattgatcgtagtcaacggtgttcgcatttcgtgggccgcatcggccataaactcccgacgccgcttttcctgtcgcttaatttcttcattggaagttcgcagggagttgaccatgccgttgaaatcatccgccaagtcatcaatctcatccttatgattactgtcaacttgaatgtcaaaatcaccatttgcgaccgagtgcgtcgcgtaccgcaatcgattaatacgacgaacggaataacgtgccaagatgtaacttaacaacagagccgcaatccccgagactaacagtgcaatgaacagatttttttcgatctgctgttcattggcctgcaaggtctgttcaaacgacccaatcgagatggccccaacaaacttcttcgttgctccattcttatagaaaaggggcactaaaacgtcaatggttcgcaacgacggtgtattcacgggttgatcacgattgcgtgttctgaacgttacgtggggcgactgcgtaataatcttattccgcttcagcttcttccaatctttggctgagatcttgggatcataaatcgagccaccaggggtcccactcattgttgtccccataccacttggatagaccaactttttgttagcatcatataccgaaaagtgaatatgttgatctcgtaagatgacggtcccatcatttagaaattgttgattaaacccgacaacttgattagtcttcgtattataccgaatagcttccttttcaatactcgcggcgtactgctgcaattgttgccatgagttttgataaagcatcgttctagtcgttcgaataaatgaaaatccgaggacgacgattaccgtaataatgacggcaaagaacgctagcatttgttgataaatcagtttcattgagcgtcaactccactatcatcaaacttgtagccgaccccccaaaccgtctgaataatttgtggcccagctttttcaatcttttggcgcaattttttgatatgtgcatccacagtacgttcgtcaccataatattcatagtcccagaccagttgcaaaagttgttcgcgtgagaaaacttgccgcggcttttgagctaaggtcttcaataaatcaaattctttgggggtcaagtcttgaatttgtttgtctgctaaataggcttcccgcgtcttggtattcagtttaaaatggtccgtctgaacatcaaaggaactcaccgtgctggcaggttggtcagccggcgtggtcttagccaaatctgctcggcgatgaagggccttgatccgagcaatcagtgtaatcggtgaaaacggcttggtgacataatcatcagcgcccatctctaagccaagtacctgatcactttccgaatcacgggccgtcaacataataattggtacagttggggaagccttgcgaatatccgcactaacttgcatgccatccttgcctggcaagttcaagtcgagcgtcaccatatcccagccatcgacatcttcattgaacatttcgacagcttcattgccatcataagcaaaatgggcatcccacttttccttcttaaaaaacatggccatcatttcagagaccgatttattatcttcaatcattaataatttcatagtgcaacgtcctccaagttaattacgattgctaactttgttgattaatcatcatttattaacctatctattatcataccctacttcgcgctaggattcaggattagtataacaacaaattaataacaaagcgtgcacgatttgtgaaataactgtgtcatcccatcattgagggacacttaataatcttggcacatcagtcacacatcataccagagtcatgctcactgacataaaaagcacgattttctgccgttcataccgaccaggaaatcgtgcatcattcagttacatttcacgagttgcgagcgtgaagtcaccatttaagttcaggatgactgccggttcgccccttcacaacgtccactatgcctaattcttaaaggagtggattggtgccggaatatgacccccacgcttaatgaacgtcgttggttgattggtgttgaccggcataactggtgcttgaccgaacaagcccccaaattcaaccgcatcaccaacacctttgccggtagctggtatgacgcgcaccgccgttgttttgttgttgatcatcccaatcgcagcttcatcggcaatcatcccactgatagtcgcggcactagtatcaccaggtactgcaatcatatccagaccaactgaacacactgctgtcatcgcttcaagtttttcaatattcaaacgaccagcactgaccgcccgaatcatctcagcatcttcagaaaccggaataaaggcacccgacagtccaccgacatgttcgcaggccatcacgccacccttcttcacggcatcattcagtaaggccaacgccgccgttgttcccggcgcaccgacactttccaccccgatttcttccaggatctcagcaaccgaatcgccttcgttaggcgttggtgccagtgatagatcaacaatcccaaatgggacgtgcaaccgttctgacgcgatggacccaacaaattgccccatccgtgtcactttaaacgccgtcttcttaatttgttccgacacaatgtcgatcgactgaccgcgaacttcttctaaggctcgttttacgacaccagggccactgatcccaacgttaataactcgatcagcttcaccaacaccgtgaaaagcgcccgccatgaacggattatcgtcgaccgcattggcaaataccactaaactcatgcaattgaccggatcgtcagccgcaatctgctttataatacgacccatttcaccgaccgcgtccaagttgattccagcccgtgtcgacccgacatttaccgaactgcaaacacggctagttgcagctaacgcggcgggaatcgatgcaatcagtttgcggtccccactctgataccccttctgaaccagggcggagaaaccaccaatgagatcgacacctagcgcttgagctgcccgttccatggttactgcgtacgcgacatagtcttgatcctgactcgcagccgcaatcaatgcaatcggcgttaccgcaattcgcttattgatgataggaatactgtactcttcttgaatttgagcggccactttgaccaggtccttcgcgctagtcgtgatcttatcatagattttttgccgggcccgctcaccatcactatcaacacaatcaaagagcgaaatgcccattgtgattgtacgaatatcaagattttcctcggccaccatctgaattgtttctaaaattgaacgactttccatggccgcctcctataacttctgaattgcgtcaaaaaccgcttgccgttgaattcgaatcgttaactctgatgcctcaccgagcgattctaacgcctctttggccgccgcaaaacttaattgctggtcatcccattccgccgatagcatcatggtaaaattatgatccatcaaggtttgcgaaatatcgacaatattgatttttaaacgtgctaactcgttcgctacttttgcgacaattcccacttggtcctgtcccacaacggtaataattgctttcatctttatagcctccgttagacgcatcattattcgcgtttgattgttcatatcatagcatgagttcttctgaaacgcacccgttacttttgatgaagtaacccatgagaataataagagattcctcataaacataggttcccagacgcacctttgctataatgaaaattgcttattattttcagaaaggagtcgtaatttgacacaacaaaatcatttacggggcgtcttactcgctagtagtgcctgtattctgtggggtatctcaggggtggctgcgagtaccctcttcatcaataatccgcatctaaccgcaatgtggctaacgcaggtccgcatgatcagtgcaggcttgattttactcgtctgggggatggtggctggtaaacatccctttaaaatctggcatcaccgccatgccgcttggacagcggtgagttacggtttgctggggctgattccggttcaactttgctatttcgaagcggttcgcgttggtaatgccccgattgccacgattatccaatttcttggcccattcattatcagcatctattacttcttatttaagcacgtgacacccagtcgtatcgaactgattggtatgatcatggcctttatcgggacactattgatcgtgacacacggtcacttaaacagtctagcaatttcacccgtcatcttgttctggggcggcttatccgccatcggggtcgccacgaacaccttgattccgcgaaccattttaccaaagtatggcgcattaaccgtcactggctgggggttactgattgcgggtctgtttctaaccttgttacaacccatgtggcgtgtccacctgacgattacctggccccaattaggcttgttaatcgtcattattctcttaggaacggtggcccccttcctgatgtttgcgcgtagtttaagcgatattctaccgacaacggccagtttgatggacgccttcgagcccttagccgcgacggttttctcgattacttttctaaacgttcaactcactagcttcgattttatcggcggcttactgattatcttggcagtcatggcactttcactgaacacacataaaatgttgcactttttgcggcgccgccgagcacactcttcatcttaaactgctgtaatgattgtcatgaccagtagacagattagttggcagaacagttgagctgtgctaaactaggattgttgaatttggggatgttctggattcgacaggtatagtttgagttcggattgcgcttcgtaggttgcgtctacgtaaaaacgctcagtttaaattataactgcaaaaaataataacaattcttacgctttagctgcctaataagcgcttaacgtagatcctcccaggatcgtccatgttctggatctgggtcctaaatttagtggacttacgctcaaagcttccacctggagttgcgagaagagactaatcaggttagtcattgctgggtgccctgtcatacggcgtttgcaatgatgaaatttaaatagtatgaatatgagcgtagatatccgaggggcaatatgcttggacgcgagttcgactctcgccatctccattactgagtttcaaagtgatgtaataagctccagaacacttgttatatcaatattcgggtctctgtcaaccggtgttgatgaagttatatttagaatccaattcatttacgaattgggttctttttttcgattttgattttgaactcaatttgaattcgataaataaagttttgccagttcttgtaaccatacgcggttcttttgatttgcttgattttacggttcacaccttcgacgggaccatttgataatcggccggtagtcatatttttgatgagttgccggttcttgataaagcttttaatattggtcattagctgaggactgatattttcgacatgacctagtgctgctttgaaggatcgataatcacgcttttgaaaagccttaactaaggcatgtgcggcttggtaggtttgtcgaaactgttggtctagatttaaaccggctacgactaattgctcttgtgtcatgcgatctttaagatgcacaaaccattggggtttgcgcttttcgaggctgtcataatcttttaaatataaccgccaataatatttaagcactcggtattcacgactcttagggttaaagcgtttcatgagttggacccgagtttgattcaaagatcgtaaggccatttgaacaagatgaaagttatccgcgaccagtttggcgtgtggaaagagtgttcgaatcgcgggttgatattgagaattaaagtccatcacaacccgggttacgcggtcacgatgacgtttagaataatgattgagaaagaagtctttaatatcggcattcttacgtcctggtaatattgtaatgatgtcgtgggtttgggcatccaccgcaataaaactcatttgtttatcagttgaacgaaactcgtcgatacaaagcatcgttggtagtccgttgaaagctggttgggtaccttgtccgagcaactttattcggcgactaatcgtattggtcgagacattgtattgagccgcaatactcgccatcgtacggtcttcagttaatgatagatcaatggcatgaagactgttttcagatatttgatgatgttttttaaccagcgtagtcgttgttaaactacttttaccacaatttttacagataaatcgctgcttctttaagttaaggatggtgacccgttcgctaattctaggaattctgatgtgaacggtcttaaagccattcttaaccatggaacgtttgccacaacgtgcgcaaacagtaaccggatacgttagcttcgcaagcacttgtaagcttccgttagtagcttcttgaacaactaaatcagtaatatttgggtctttaatttggagcagtactttagtagaatggtcttgggacatatctgacactcgctttcaattggttttggtcgacttgattgtagcacaggacgatatgtccttttgttgtacataaaaatagtgttgatggattttatccatcaacactaaatatcatagaccccaatattcattaaagctatcctaacgggatagctttttttgtcctattttgattagcgtgctacttcagtaaaaagcccttttccaaattggaaagggctttttttaccgataatacaaccatggttaacctgatcaaccaaaatctgtccaataattataaacgccacagccaacggtgttaaagtggattgcaaccagtctgttaaaataataagtgctcacggcactaatccagctgcgttagcatgcggccatttagaccgtaccgacccgctggcggttaaacccaacctgtactaagatccgatacaataacggcacaatgatgacacatgccaccgcattaatggtcgctgctaataaactcgtgaaggacccaatcatggcgaccttgagcgttgtccccaccattaaggcttcaatcacgcctgtacaccacgaagtgacgatttttgtgagccctgcgactaacgatacccagtaaagccggccaatacgatcttcacgatagccgattgacttgaaactcaggttgaccatcgcggccagaataattgcttcaataattgttaaccacgaagttgcggcatacccattcagaatatcaaacaagccaagccccactgcaccagccgtagcaccatagccaaaaccaagcaacatcactgcgagcactgtcaaaatattaccaaaatgaataaatggccgcccaacaatcgcgggcaacggaattcgtaatacactgataccaataaaaataatggcggcaaataaccctgccaagacgagcttttttaattgttcagaccttcccattcaatttcctccaattttgcacatctatttatcattatattctaatataagtgtgaatcaattgatagtcctagtctatttttttcgtgacggtaactgaataatagtcgctcgtgtgggcgtctcaacacttacttcatacgcaactgccaacaaatcataagcagctcggggcattttgtattgatgacacactaaataataacctagatcaacagcgatttggtgcgcgatagcaatactgtcaccactacgattaagccggcgacgagcccgcgcaactaacctggtcaacacaacatcgcttcgaatctcaattgccatgctggcaagtgctagttgggcacttaatcgttcattcggttgggtcgtacgtgcttttgcctttgccatttttttcaactcctcagtgtaatcataggagtttcactttggcttcgcaacgaatgacaccctcaaagccgcgtcatcactgagctcgtttaactttcacaaaaaatattattgaatcatttcaattcaaattcagcaacagcgcccacatcactagtccattccatataagtaaatttaacttacgatttaatttatatctgccaccgatacttaatcatccgtctcttgattcggtaacccgaatagcaataccccaacaccgagtaagagtacggccacgaacaccataaaaattgccggaatgccaaatccaattgccatcagcgcaccaactaaaaatgggccgatggttgcgccaatgcgaccaattgactgggcaacgcccataccaattccccgtaccgcgggcgcaaattgccccggtgtgaaagcaatcataattccccacgcccctagcgtaaagaacgacaaccatgcaccactaatcagaatcatcgttggattattggccgtcccaaaagctgcggcactgacgaccgtcccaatcagataagttgccaataccgccttacgcttgacgacgccgatcaaccacgcagctagataatagccgggacgttgcgccaagctcatcaacatcgtatagccaaacccatgtactaatgaaaatccgcgcaacaccaaaacgcttggaagccataaaaacataccgtaataggcaaacataatcacaaaccatagaatgctgaggcaaatcgtagctcgtcgatatttagcggaccacacttgccgcaatgcctgtctaaaatcaactttttgtggccgattagcctcctgttctgcaggtaagtgtcggcgtaacagcaacgcatacaaccccattaaggcggtgattaagaccgtcatccgccaaccaatgtgtggcatcactaaaaaggccaataacgatgctgcaatccagccaaacgcccaaaaactatctaccaggactagcatgcgtgagcgctgtgttcccgtataatgatcagcaatcattgtcgcagcaaccggtagttcaccccccagaccaatgccagtcaacaaccgaacgactaagaaccactcgacgttcggggtaatcgtcaataacaaattaccaagcgaaaaaagcagtagcgtcccaataaggaccggcttacgccccaatttatctgctaaatagccgcataccaaggccccaatcatcatgccaagcgtggtgatcgcactgactgctcccaactgtcctgcagttagctgccaactttctttaataaccggcatcacaaatgatagcagggccacgtctaacgcatcaaaaagccaggccgtcccgatgacccataatagcttagaactatttcttttactttcgaccattccaatactctcccaaatttcctaattagccttccgctaatttaggtattttttacctttatggtgctataaaagtagcataccgacttggacgtgtcaaatgaactactttagccggtataccttagcggggcgtccagaagagccaggtcgggctgtccccacctctgtaaataaatgaacgtgggttttacgaaagtttgaattgtcgatggttgccactggctgccgccacaaaatcgcatacagctggcgcgcctgtttgagtgtgaactgctcacctaacactaataagatcgtaggagcatagtccaggcgattgcgcacacgttgtagggcgtttcttaagatcaggccatgatcggcggttaacaactgcttggcgattcgttgataaaactcccgctccgtctgcgaatcgggaacaccagcaaatgccaaaccatcagcgaccagatcatcacgatccacccgcggcgtaatggcaaaccacttgacatcgcgcgcaccataccccggaactagttccggcttgactggcaaataaaccatatacgtcaacgccagtgagcgttcacccggcacgcgatcgaccgcggtaaacgtccctaactgttctgtatggaattgggcaagctggacgcccaacttctcacgaactaatcgcaatgcggcttcatccgcactctcatccgttctcaaatacgtcgtcggtaatccccaggtattctcaaaaggagcgtgatcacgctgaataagcaggaccagcagttgcttggtcactgcatcgaaactccagattacgttcgtaatactgattaatggccgataactgacttcatgcgccattcaaatcgtcctcctacaaaaacggccactggcaaatgccgtggccgttgtttattttttaattcattgcttgtagcgcttgaaccgtccacccgttaatggctgacttttcaataattgctttttttatttcccagacatccgctttgatatagcgatgtcgggcggtcattaagggaatatcagtgtagacctcttgaccgcgattaatggtaacgcgcattgaattacatcctttcctaatgctcaggaaatctgtaaataattctaatactcaatactggggcaagtacatgatactaaaaattaatttatccaaaatctgaggtaaatttaatccggcagcgtgaagtccaccgaactaacaattaactttatcatatttttgaagttatcgctaacagaatgctctttctttgacttaatttaaatttagccctaataatgaaggcgtttgcattgtgtaaaaacagattccgatttacactaaaggtaatattataagggaggtttttacatgcgcaattataaatatgccgtatatagcggtatctcagttgtttatttaattaccctatatgcgttgtaccaccttattcgaacggcttatattctattctttctctagcccagaccaacccgctgacttcaggatgacgatcatcaaacaagctcatctgacctgactaaggccggatgagcttgtttgattttgattctaattgcgtaacgtgactgactcacaatcccaaaccaactactgattagcagagccccagtcatatcatcgatgccataaaaagcggtcaactgccagtgctaccttagtattttcatgtaactggctgtgctgcgcatgggccccataaaagtctttttcggtgtaatcgacatcccgcccacgcaataaatacttgatggaacgggccgacacgttggtgaccaagctgtccgaatgactaccatcgttcaaggttcccacgatattcaatagttgcacatttttaggaaaattgttccgcttggctgccaataattcataggctgcatgcaaatatttcggttgcccagaagtcagaaacgagttctgattagcaacatcatcttccccgaccaccccatcaaacgggccagcgatcgttactaacttattgatcttcggaaaagtcgtcgtttgttgcgtcatcagcatattaacgctagcgacacagcccgcagaatgggcgacgatattataatgtttaaacgcgtgctgttgttgaaccgtggtaatcaccttagccagccaagcactctgttggtcatactgggccagattgttcttgaacacgacttgaattatcgggttacgcacccgaccacgccatttacccgtcaacgtcacttgaccactggtactgaccgttgccaccaaaactttgtgagcatgagcagtcttttcagcatgcgcaatcagggtattcgttgacttcgcactcccctgaaacccgtggacgtaaaatgtgggggtctgttgattcacatacggcgatatttttttagtacttgccgcctgttgcgttgcttgtttcttagtggtttgagaaccgcaaccggttaagccaacgactaataagactgccaacagccaccatttaatttgtttcactttatccgccccattaatattttgaaatattctactttaattaaatctaagtcaattgaactcacattaccaatttcgtttgacagcgaccaactcatcttgtaaataagtgcttgctaactgcaagtatgtcacgtgtttgccaggcgtgggtgcatgtaatagccagccatcaccggcatatagggcaacgtggtgtaccgcaccgttcccatgattatgagcaaagaaacacagatccccaagctgggcatttgctaagtcgaccgccactccttgcttgatctgatcctgagcatcgcgcggtaagcaaatacctagactgcgatgcaaggtatagacgaatccagaacaatcgaaaccataagcactgatgccaccccataggtagcgtaaatccaagaattcttcaccgagtcgaacgagtgtcgctcccggtgtcaagcgcgcggttctaaatgcaaactgcgtcgcacgttttgcaattttgcccgttccgagtggggtctggaccgtataataacgatgatctttgctactaataacgggtagttccgttccaaggctaagatttaagaacgtacggccatctaagcgtagtaacggcgtaaaaccacgccgtatcgtaatcatcggcccagtttgaaccggcaatgggacggtcgacaattgcgccgcccatacccatcctggatacccctgtggatgccgggagtcggcctgattaacaacgtaaccataggcccagccattgacaaactgttcgactaaaaagacgtcgttaaataacgcctgcgtcacgatgcgattgtcgcgttccaaagccacagtatcttcatctgataactgcgccaaccatggttgtaagccgacatttgctagtgccggagtatcgatggacgtattgtttggctgccgccacacgttcgcaacggccgcaatgatccgtgttgattgcattctagtcacctcattttttcagtttaccatatctccggaaccacgtctggcttcctggtcaaaccttgaagtgattttaactttaatcgatcgccccacaccgccgtggcacctcggcacgttaagaagctatcctttcagtagaaactttacactaaatattaaaaatcactgtgaaagtatgctatgatactaataattacttaggaggcgttttaacgatggataaaaccgatttgaagattttgaacgccttgcaggccgacgcgcgaatctccttaaaagcgctcgccgatcaatgcttcatttcttcgcccgcaatttccgctcgcatcactcgtctgaaaaagagtggcatcattcgtgactatcaagcaaatcttaactttgaaaagctcaattaccacataaaagcctatattcaactccaacttgaaccaacgcaaaaggagcgcttttacccatttgttgccggcattcctaatattctggaatgtgactgtgtcacgggtgaatactctcaaattttgaaagtgattttcgaatcaacgcaggcattagacgagtttgtcaaccaattacaaacatttggaaaaacgagtactcagatcgtcttttcaacaagtgtccctaaccgtggcctcacgttgcccgatgatcatgacatgtctaaaattaatcattaatccgcatgcacagggaaactgtagcttaataggcgcaccgagaaaccatgttagtttctcggtgcgcctatttaatgaattccaattgcaatgtcagagatcggtagcccgcttcaaatcaaacccaactatcagttatgggcacctcaggaccaattcaataacctaaaaatcgcttgtggtgtcgtcacttgataatgacgcttgagaacttctaagccaatattacagcctaccaatagactcccacctaaagccacgcccacccataattgtggtcccaaccaatgaatggcaactaaactacacaaaaataacaccgcaccaacaatcattcctagcgtgtaactcacaaaccatcgtctcattgggcacctccacgacacaaactaattacgcgaatcggttcatcacataaattgcaccaagtccaattccccataaaactaacagcggtagtaaaacgagcatgccgaactggtaccaacctaataccatcataaataaaatctcaacactatggccgaacactaataattgaaagtattcacgaaaataccactgcacgccgataccaatcaagaaactaatcaagatcacaccatagaacgtttcatgcagcattttacaaactcctttttattgcgtttgctatctaaccttacatggtaagtatgccgtattgaggcctaaatcatcatcatatttatgtaaagactaggttatttttcagtaaagactgtttgatgatttttaaattattgcaaactgctgttaacagttacctgcgtaacgtgttatgattaaagggcaaattaattaaacgcaacaattatgggggcgcactgtgttacatctacttacgctatcgagcttaggccgagatctttttaatatcaaaatgctaattgtcattctcattacaattggcctgatcaccctaatgaccattctgacctacctcctagagcaacaggtccatcgtcgtcaaaatcgacattggactattggggcccatggtgccgaggctttaagtgtcctcattagtatgatcctattacgacaaatattcattacgctgaattcaggtagcattatcagttggacctacgcaacggttcaattaacgattcttctgttcagccttaacaccatgcgcaacctggccgttgaaattattaacctgttaatgccattgttcatttatggtcaggccatctggttgggccacagcacgcagtacctgccagtttttctggccatggccattatcttgattagtacagtcgtctatattactcataactatcaagaattacacgctactcaatggaagtatctcctgttccaaatactatatagtggcacttggtggggcgttatttggtcagttcatccgttcaaattgagccatacactcgtcatcattctagcctttgtcctttacatgtggttgattcgtttagcagtcaatcgcgtccaaaagtttttcaatgaagtgctcacctttgatcaacaagtcaattacgatgaattaaccggtattcgtaaccgcgccagctttgacacgcatgcgcgtgaagtgtttgccgcgtatcagcaccatcaaatggggcccgtcactatggtcatgttcgatattgaccactttaaagcctttaacgatcagtacggccatctggctggcgacgccgtactccgacacgtggcgcattttgttgaacttgaacttaatcagcgtagcactcacggtcagatcttccgctatggcggtgaagaattcgtcatcatttttcgtggcatctcagcgcttgaagctggtcaaataatgcgtacgattcagcgtaaactgaaaacagtaccaatcaaatttaacgctcaaacgttgaacgtgaccgtttcaattggcatttcagaattgcaaccaaccgaccagactttcactgattggttcgtccgcgttgacgactaccactatcagtccaagcaggccggtcgcgaccagaccacggttgaaagtcaattactaacggattaataattgttcccaaaaggccgttaatttgtaaattcgttcccgatttacaaattaacggccttttggggtttagcgattaccgatggggacaatggcgcgctgacggtccaataattactgaatcgccagcagtccattttcaaattaactagtcagctaaaaataattttctcctaatcaggacatccaaaaacagtccatgcttgaatgtctgtccacagacaagcccaagcatggactgctattaaaaaggataagaattagccttgtcgttctttcaaactgagtttctcgacgttcaattccttgtcaacccagccattcacaaaactgctctcatgactaaccaagattagattaccttggaaagcctgtaatgcacgcttgaggccttctttagtttcatcgtccaaatggttcgttggttcgtccataattaagaagttacttggaaccaattcaagcaaggctaatttaaccttagtctgttcgcccccactgagtaagtgcattggcttcatcgcattcgccgcattaatcccacacttagccaacttagtccgaattgtcttcggtaacatcgtagggtattcattttgaatcgtctgtaacggtgtcaactgtgggttatcccattccaaatcttgattgaaataattgattttagcagatggcgaaaaatctgacttaccacttaacgctggaattacacctaaaattgacttgatcaaagttgatttaccaaccccattaaagcccttaaacgctaatttttcaccgttggtcatcgtaaaagtcacgggttccaacaacggctttccgtacccaacagacagcttcgtcacactcaatgcattttgagaacccgtatcaaggtatggaaaggcaaacttagcgtgttcattttcactcggtggatcaacccgatccaaatgcgatagcatcttttcccgtgacttcgccatcgttgactttgaaccggccttgttcttgcgaatgaacttttcggctttttcaatcacaacttgttgcttttcaaacgccttcagttgggcttccttacgtgcttctttttgccgcatagccgctttaaaatcgccccggtacttaataattttaccgaatgccacgtcacaaatacagtttgtgacctgttgcaagaaatcatagtcatgagagatcaccataacggccccttcaaagccgttcaaataatcttccaaccaactgatatgcgccgtatcgaggtagttcgtcggttcatcaagaataatcacatccgggttttccagcaatagtttagccaagatgatcttcgaccgttgaccaccagacatctcactgatgacgtgatcccgaccgatttcatctaatcctagtccggtaattacccgttccatttctgtctcaatatcataaaaattattggcttccaaggtctcctgaatcctacctgcacgttccaataactggtcatccatcttttcagcataatccgcataaagttgttgcatctgcgcatctaaatcatacaagcgttgaaaagccgttttcaaaaaggcgtatagcgtcatgccggctggaatatcggcgtattgatccagatagccagttcgaacgttgcgctgccacttgatctgaccagataatggtaagatctggccagttaaaatcttaattagggtactcttacccgccccattttgaccaacgatacccatatgatccgctcgttccagcgtaaaattcgcatcgtcatataatttacggtccgcaaagctttgcgataaatccgttacttctagtaaagccatgttgttttcaacctacactttcattttgacccgtattaaaacgggccccgtcatatcacgaggcccgttgcgatagccctgatactaagctagcaccaagtctttatctagttcatattgcatatggaagtacatccgatcaccgataggcttaattcctaccgattcgtaatgataacggtcatagagcttcttagctcctaaattagccatgtcaacgttcaaaccaatccgcttttgaccagcttgtcgcgcgtatcttggcagggcggcgagtaacttcccgccaatcccatgaccctgataattcgggtcgaccgcaatcgaatccaggtaccattcgtgctcataactttcagcttcagcttcaaatgctgaaccaaacgcatcattattcgcagtaactcgtgctaacacgtcgtccaccgcgtcctcatttttgtcaggataaccaaacgctaccccgaccacttgaccatcggcctcggccactaccgtcgttgccttaccagacaaataatcaggtgtccggtaagcggcagtaatggcctgctctaagtcaggttcaggaatgtcgtctagttcctcaagttgcatttcatcaaaaatcatattaattagcggtgctatctggcccgcgtcgtcttgatcggctggtcgaattgttatcacgaatagccctccttcttatagtaacacctacattactatgaaaagcaagcattgtcaaaagtcgcgtccggtgtgaacggttatagttgttattttttgagttgcttcccaaatactgtcatatccgtcccattatcaatcgtggtatactgaataacaccgtcttatactcattattattggcatgaatcatgattaaaacgtaccagttgtgtcagttcaaaagcagccagcttaggcccgctggaaaaagatctatttagcgtaaacttgcttagttagcgacgtcctacaccgacttccaggcatttctgccaattgctggaacgcggtggacacagatttaagccgcagaccacgtcttaaatactggtcttccactaaccaagcattggccgaaacgccttccagtcgggacagtattcgaatggctgacgaagatgtacccaacctttgatggacttatcattgttcctcataaacggtaattttgttaattacctgtcagtctgaaagtgatattgtgggagctcactattcctcaagtggcatagtaataatcgaacgtctcgacaaagtggttaatggaaccctgacgtttcgtttaaggttccggtgtcaaaatagtcagcgacaaattttaccaagttaagtggccgttaatctgccattcgagcgggttccaaaaacgtgttcggtgccactaaagcctgtgcttgctacgccaacggactaatacccaaaccgcattaatccgttggctagacaatgctcggcttcaacccgtggccccgcacaggcttgagactggaggggctgggtgacaatgctcagtagccaaattattctaagccggaagtgtctttcttccggcttagaataagactcgtatttgagatgacgcgggttatgcgttagctcaaatcgacgtcggctgcgttccagcaattgtcacccagccccggaggtcggcataggacgcgcaacggctgacgaacagcaatctaactggtacattttaatcatggttcaagccaaatctgatgagtacgacacgtttaataatgaattatttttgaagggatttgagcttgtgaatattcgcgatatcgatcatttgaccctaaccgttactgacattgcacggtcattacggttttaccatgaagtatttgaccttcccattgtgaccttcgatggtgaccgccaagctgtcttagtgggtaaacaaaaaattaactttcagaccactaaccagccacaccaacccattgcggctaagccgacacccggcagtgcagatctttgcttgattgcgaaggataatattgatgatattcagcatcacttaaagagttatttcgtggatgtgattaccgggccggttgaaagaactggtgcccacggaaagttgacgtcactgtatgttcgtgatcctgataacaacttgattgaaattagtaactatcattaaaaaacaccacaaagactaatcattaaaaacgcccagggcaactgttcagtaacttgcgaacaactgccctgggcgttttttgatcgttatctggatattttaatcaatcgttgatcaatctgcactgctagctgtgtcattccagcggctgtcagtcccgttgcttctggataaatcagaactcgcgcactagcttgtaagtccaacacggctgccactggtcgactgacgaccagcaattggtggtcggtcaccggtaagtcgtccgcggttgcaaccctgaccttaagcatcgattgagttagcgcctgcattagtcgcttgactagtcgtgcatcaagtgccgcgtcaatcaccatgcttcctgaaactgaattctgtaaaatccccgttggcgttgagttcaatactaatacttcgtcaatcatgttaccgcccccctataatgccaatagtatatcgtgggagtcagcgggaagcaatcaaacgcactgtccccgcatcaagctgttcatttgctgtcatccgttgcctcgataaccaatgcgacaaaaaaagttccgcctaaatcgaaaagatttagacgaaactttttcaataaacccaacgtcgacagcgcgtaacttattcagctgcgccaatcaaatcaccgctagtcacatgaccagttggattaagggttagtttgttaacgtgatccatattggtgataacgaccatcatggttgtcgctttaccggctgacttgatagcagccaagtcaaccgtcgctaccgcagtaccggccgcaatttcgtcacccgttgccacgtgtaacttgaacggcgtaccattcatttccacggtattgatccccatgtgtaataagacttctaaaccactcgtcgtcttcaaaccgatagcgtgtttggtcggaaagacacttgtcactgtcccactaaccggagcaacgacttcaccatcttcgggttcaacagcgtaaccatcacctaagagtttaccagcaaacgtctcatccgcaaccgcactaatcggcattaattgtcccgttgccggtgcccgcaaaatcgttgtcaccggcgcttccgttacagtagcagtttgcggttcaaccggggcctttgattcagcatcagatgccggggtcgtcgccacctgaccagaaaataatttttgtaaagcctccgcgacgaactggacttccgtgccaatcacaatgtgaatgttatgaatatccagtacgttcaaaccaggcacgccagcagccattacggccggctgatcgactttttccgtatccttaagttgtaaccgcagccgcgtcgtacaattgttgatcacactaatattgtcatgaccaccaatagccgcataaatttgctttgcttggcgcatatacttatcatccgttgctgcaacggtcaccgctggactagcaggtgcacccaccccatcgacatctgcagacacaacttcacgaccaggcgtcttcaaattaaaccgtttgattgcaaagtcaaaaccaaagtaataaatgacggccatcaccagcccttgaaccagtaacatatagggttggttggctaacggcatccgaaaactcaataaataatcgactaacccgccactaaacgaaaagctggcggtccagtgcattaacgcggcgaatcctaatgatagtcccataaaaacggcatgtaataagtagagcggccatgccacgaacatgaatgaaaattcaagcggttcggtcacccccgtaaagaacgacgcaaacgcaccagctaacatcaatgaacccacttctttttttcgttccggtcgtgcattacgataaattgcatacgcaccagctggcaagccaaacatcataattgggaagaatccagcttcatacatccctgtgattcctttaacaccatggctggcccagaaattgccaatatcattgatacccgcaacgttataccagaatacggaatttaaggcatggtgcaaaccagtcggaatcaataaacgattgaaaaagccatatagaccagcccccacgaaacctaattttgaaatccccgttgcaaagaggacgatggcatcgtagacagacggccaaacaaggtacaataccgccgtcacaatcagcatcacaaaagcagccataattggcactaggcgtttaccactaaagaatgagagcgccattggtaattttacttcgtggaaccgattatagagcgcagccgcaatcagtccagcactgattccaatcagcacattgttatctaacgcgctaaatgctggattgatctgactcactttaacattcagcatcgtcgctaatgtcgctggttttaaaaccatcaccggaacttcaaacgcgatcaaaccagcaatagctgccgcgccgtccttattgactgacatcccgatagctaagccgactgcaaacagcaaggctaagttattcaggacaacgttaccaccctgaatcaagtaatttgcaaacagccactgttttggcaggtaattcccaatcccaaccaaaatcgctgctgcgggcaacgttgcaatcggtagcatcaatgactgaccgattttctgaaaatatgtcttcataccaatttctcctcattctctttttaagcacgttataaatcctatcacaacatgttttcattgcaagtttacaaggtcatctaagtgtatagaccaatgttaaagaaaccgatttcaaccttactaaattaagtttttccgcccacaaaaaaagttctgaaaatactcagaactttttcattaataatcttatttttcagcaacggggatttccgggtgccggtattgccgcatcatttctgctaaatggacttcgtgagtcacaaactcatgcacgcgacaaacgtagtcatgttcccgcccaatcttagcaatatagccattaatataatcaacttcggtcggccgtccctttgagaagtcttgatacattgatggataatggtacttataggctcgactgactgtttcaaccgagtcgatttcttcttgccgcgtctcaatgagtttgatgcctgccctttcgcaagcatcataggcttcgttgaacatttgagtcgccatatccttgacgcccggatattcgatgaattggcccatctgaatctcgaacatcgtgcacaaactattggtgaccgcgttaaacacaactttggacatgcacatgcccataaaattatcagaccaaatcggatttaaatcagccgccttaaaatcggccatcacttgcttggtagtcgtatcaataggacctgcatacttactcatatgcatcgcctcactacccttaggccccataaaatcaaccgtacccggaccattcaagaccgttgcaatcatcgccgtaccaccaataatgtgattttctgggaaatattgtgcaatcttttcaaagtgccccatcccgttcattgcggcgaaaacgtactggtcctcatgaaataacgacgcatcgcgcttgagctcatcggctaactgcatttgcttcttaaaaacaatccaaacatctggatgaccctgatattcttcaggataataaatattgattggaacgacatggtgattttgatgatcacgcgccacatcaacgccgccctgctcacggaccttggcgacgtttggttcccacgtgtcgataaaatcaacgtcaacaccggcgttttcttgtaacattacaccataccgatatcccattgcgcctgcgccaataatgccatatttcataagtaaaaccatcctttcgtcttgcccactatgtgtatatgttccccgctcgcttcaatgcttttccaataaacgggcccgtgcttacgatctactatgtgctgtcacgtgatgtcgaacaactatgtgtttacgatgattaaccgcgatgcgcgacctaaataatgactactatgtgttaactaaaaaataatgctatgtgtcacttgacgaaaaagcgccctttgaataatcgaccaaattattcaaagggcgcttacgcgcggtaccaccttattgctaaccgaactcacatccggctactcatcgcgttcacaacaactaaacgcgtgcacaataatgggtgctaccagtgaatctcgtaaaattcacgccaatcctttaacttttactcacttgtcatcacaccttcacagcaacggcgctttctgagcatcacaagtcagttactccttaaagcattatagcttttcatcaagttttaatgttataaccataatatcattttagtaaaatgtcaaccttcgatgcaaaacttttttaaaacccagctgtctgtatacgacagtatcatcagcaaaccgcacacgggcaaccccaacggcctattgtttttgctcctgattgagggtcgtcaacaatggcttccaatctaatgaccagatcattccgagcgcatggtctccagtcaagacgcctaaaactggaccgataaccccagtcttaacccggactgctggaaactgataacgtagttcgctcgcccagtcttcggcaatctgcgcgtcattagcgctgatgacgtccaaccgaactggtaattgactgttcgtcacaaactgactaaattcatcttgaacagcctgttgtgcatttttgagcgtccgttccttacctaaaagttgaatcttcccatgcccattgaacgtaataatcggcttattgcgcaacaccatcgttccggccaaactactattattataaatccggccatttttaactaggtggcgcatcgagttaacaattaagaccgtcgtcgtagccgcccgcaagcgcgtcagttgcgcaataatttcatctaaggtgtagtccgccaatgccatggccgcagccagcttcaccatgttcgccgtccccgcgcaagcagttcgtgaatcaaacacccgcacgtcaataccgtcaactgacggcgcataggtcttcaaattattgatccagccactgataccactactcaacccaataactaaaatttggtcatagcccgccgcttgcagctgatcaaaaacgacttgcatctctggcattgaaatttgagaaatcgttggaatttctttttcaacttttagtaatcggtaaaattgatccgtcgtgatatctacgttctcgtggtaaacatgattaccgaacataatcgggtcgttcaccaccgtaatttggtagtctttcaccgcctgcgcttttaaattagcagaactttcggtcaccaccgcaattttcataatttcactcctcatcgtgtcagtcaaccaactgccacgtctcgctaactcatttcaattagctcatccacttagccatgggtatcccatgggaacttagcatcaaaaaaagacgctcagatacagtatactgtacctgagcgttctttttcaaattgcaacatttatgggagatgttattgaattttcgttcacttgcttccagtccgttgtaccggcaattggtatcaaagtcagtggcaagttcgcacgcagctttttgcgtttcaccgcacttaatccagtaatctgataacaatcatcggcaatcgtttttactgagaaatcagcttcattagcgtaatatttcacggcttctggtgcgaccggaccaatgcctaagtatgtttgtggtaactggtcaaatcgagtgaccgttaacgagacacttcttttctggttacgaatcattcgataaccattgataaggtgcttggccgctactaagacgtcatttagaacactattagccgtcgccgtacttcccgcacccggtccggtatacaagctggtaccaatggcttcactttgaacagctaccgcgttttggaccccattgatctgactcaggggttgatcaaccggcacggccactggcgccacacgacaatacaaaccagatccgtgtcgctgaatctgcgcgagcaatttaatctgccagccattttcagctgctaatcgacaaaccgaagcgcttaaatgcgtgattcccgtgggtgcaatctgcggcaggctcaactcttgcccaaaagcaaagcgactgaggatcatcaatttgtatgccgcatcaatgcccgcaacatcattagtcggatcagcttcggcgtacccggctgcttgtgcagtagctaaagcttgttcgtacgattgcccggttgccattgcacttagcatataattagccgtcccgttgatgattccgctgaccgcctgcacattgtccgtcacgtaactatctgttaatgtccgcaagatcggaaccccccccgcaacactagcctcgtaaaataaatcacagccctgttttttggctaacgcagccaattcaggtcccgccgttgcaattaagtctttattagcggtcacgacagccttaccctgattaagtgctgccacaatggcctttttagcagttgcgaccgtccccatgacttcaatgactagttggatttttcggtcacaaacaacgttcgttaatgaatcggtcaagcgcgtcccaatcggtaactgaacagtccgaggcgcgttcaaatgattaacggcaactgctgctagatgcaaccgaataccctgcgtttgttcaattttggcagccgagcgggtcaaccgttcaaccaccccactacccacagttcctaaccctaacatgcccacttcaattgtcgttgtcattgtcgcaccctccgtttcacatactttcaatcatcgaccattccgacctattaaacctgtgccaatgcttgatccaaatcagcaattaaatcatcggcattttcgacacctactgaaattcgaatcaagtcaggcgttacaccagctgctaacaattcctgttcatttaattgcgcatgcgtggtggaagcgggatggataattaatgatttagcatcagcgacgtttgctaacaatgaaaagagttgtagatgttcaattaatgccttaccagcagcctcgccaccagtcaagcccagggtgaagatcgaaccaaccccattcgggaagtacttagttgctaagtcatggtatgggctatcttccagttctggataattgacccaggcaacttttggatgtgcttttaagaaggcaacaatcttgcgtgtattggtcacgtgtcgttctactcgcaatgacaaggattctagaccttgcaacaacaagaaggaattaaagggactgatagttgcaccggtatctcgcagcgtttccgcccggaccttagtcgtaaaggctgccccgcccaaatcggcaaaaacgaggccgttatattgcggatctggcgttgtgaaatctggatacttgccactcgcacgccagtcaaattggccgccttcaacaataacgccacccatggtcgtcccgtgaccaccgataaacttagttgctgaatgtacgaccacgtcggccccatgttcaagtggccgaactaggtatggtgtcccaaaggtattatcaacaataaaaataatgccatgatcatgagcgatttttccaatggcttcaaaatcaactaagttaatgccaggattaccgatactttcaacgtacaaggccttagtatgatcgttaattgccgtctcaaaatttgccggttcgtcaggatcaacaaagtgcgttgtgatgcccaacttctttaacgtcacgctaaacaggtcataggtcccaccatacaaggtgttggccgccacaatttcatccccctgttgcgcaatgtttaaaattgccgcggttatcgcagcagaacccgttgcgagcgttatcccagccgtcccgtgctccaaggcggccactcgtttgtcgaccacgtccgtcgttgggttcgtcagtcgtgtataaatattgccggcatcagtcagggcaaagcgacccgcggcttgcttggcatccttaaagacgtatgaagtcgtttgatagattggcacggcccgtgcgcccgtttcatcaaccgtctggcccgcatggacttgtaacgtttcaaagtgataattttcaggattcgttgttgtcataattaataacctactttcgttaaattcaaagttgctaaccagttttgatacagttgattgcttgaagtttgccaactataatcaactgttgttaattgttcagtagcaaagtaatgttcaggtaactgaatcggcaagtgcttacgtcggtcgcgcaaatattcatcggcaagtgtgcggcgttcgtattcaggatgaccggtcacatagaccgcgtgcagcttgggggcagataagacgagcggtcccaccttcggattgtcagcgacaacctgcaatccagcgggtaagcgttccggcatcactagtgctgtatgccgtgactgtggcatttttaataagcctccagcattcagtccgctaatcagcggtgacttaacatcagtactagtcgcactataaataccgaatatcttgtgagcaacggcacgctttgcgattccaaactgtgcgtatagccctgcttgtgctgcccagcattcaaataaagtctggctaacgtgctgtcgtgaccaatcaatgattgttaacaattcgttccagtaatcgactgcttcaaacggtaacgtctcaactggcgcgccggtgacgatcaagccatcaaaatactgatcttgaatatcagccaacgtcacgtaatgtgccgcgaccactgcttgtggcaggctcttgaaatggtgactcgcgggatacataaacgtcacagccacatctgtgttaccggctgcaaaacgctttaggaactgccgctccgtcgttaccttagtcggcatcaagtttaaaattaaaatctgttgtgcctgatgactttcttgacacgttgcgttcgcccattctccacgggccgctaataatccattatttgctgtgactgtcatctaaccgctccctctcacctgtattgaaacaaaaaaagctcccatccattagtctctaatatgttagaaactaacggacgaaagctttcgcgttaccaccgttgttcgctgccatctcacgatcacaacctcgacgagtaccctgaaaaatctaggaaaccccgcaatatatcggttgccaccgcatgcgtagccactacgacccgcatcatgactccaagctcatcttcaccgcactcctgaatacttctctcaccattacgaagctctctgcaaatcagtgatgcgattactcttctcttcaacgtcttaatctgtttttaatttaaaactaatttaacaccgcctttattcattgtcgactcattttattgttttttcgttatgttttacttgaatgcttattcaaaacttgctgaataactaaaatcaaaagcagccagcttaggcccgctggaaaacgtgcgagttagcgtaaacatgctttgctggttcgtcctaagccaacttacaggcatttctgccaattgccggaacgtcttccagtcgggatagtattcgaatggcggacaaagatgtactcaacttttgatgaattcgtcgttgctttttataaacagttattttgtcaatcaactgtcagactgaaagtgatattgagatagctcactaatcctgaatcggtgtagtaagatttaatctctcaacagaatgctttaatgaacctaacgctttgtttaaagtgccagtatcaaaataggcaccgataagttgcgctaagctcggtggtcgttcatcagccattcgagcggtttcccgaaacgtgttcggtaccactaaattctgtgcttgctacgccaacagactaatgtcaaaaccgtattaatccgttactagacaatgttcggcttcaaccgtggcccctcacaggcttgagaccaggcgggttttgctcgggcttaaatcgacgtcggctgcgttccagccattggcaccccgccccggaggtcggactaaaacgaacaaatgccgacgaccaagcatccgcatctcacaagattttcaccacaaattttaatatttggtgaaatttatccttgacacttttttcgactttgcctatactgaactcattcaataacgaaagcgaggaaccaagcatgtcaaagtcagttactaacttgaacagttcatggcaaagccggccgttcagattgtagtgccgtccacacggatacaatctggcaaacagtttgtatctgtgccggctcactttgatattcaaagaagtctgcatgggttttaacacagcaggcttcggttccgtaaagggcaaaccagagcttactggtttgcccttttttattggctttgaacttgcccgagcttaagaaattttttgaggtgattagattgaaacgtatgattgcattcattagtgccttgatcgtctttctgggagtggcctttgtcatgacaggcaaaaccaccgccacgaagacgaccagtacaaagaaagtgccgacggtcggcattcttcaactccagacccaccccgcactcgacgcgattcatcgtggcgtggtcgctggtctaaaggaatatggttatgtcgatggcaagacggtcaaaatcgactatcaaaatgcccagggcgatcaaagtaacttgaaaaccatgagccaaaaattcatgaacgaaaacgccgcgttaacagtcggaattgccacccccgccgcgcaggccctcgcttctgcggctaacaagcaaaaccctgttatgttagcaggtattactgatccatcgggtagcggcctaattaaaagcgaccaacatcccggtgccaatattacggggacttctggtgaatctccattgaaatcccacttagacttgttgcggaagctcgttcccagcgctaaaacaatcggaattatttacaccacttcagatcatggtggtgaatataacgccaaaaagtttgcacggatttgtaaacaagaaggtgtgaaatacaagttatatactatctctaacaccaacgatatgcagcaagtggctgaaaccatggccgccaatgtcgacgccgtttatgcgccgcaagataatggcgtcgcaagtgccatgaaaacgctagtctccgttacaaataaggctaaggtaccagtcattccagccgttgatacgatggttaaagcgggcgggctcgcaaccttatccgttgaccagtatcaacttggtaaactaactggtgaaatggcagcccaagttttaaagggcaaagcaactagcgactacccaatcaaagtcatcactaagggtaagatgaccatcaatttaagtgaagctaaaaagctcggcatcaagttcccagcaagtgtccttaaagaagccaaagcgaaaggggttatttacaaatgagtatgatcgtatcgagtatcggccaaggcctcttgtgggcaaccttaggcgtcgcattatttttgacatttcgaattcttgattttcctgatatgaccgtcgaagggacgtttccactcggtgcggccactgctgtcatggcgattagccatggaatgggccccgttaccgcttccctgttagccttcgttgcgggcgcgattaccggcctggtcaccggcctactttataccaagggtaaagtgcccattctcttagccgggattctagtgatgaccgcgtgcttatcaatcaatttgcgcattatgggcggcagttccaacgtttcattgctaggcaaacaaactattttttctaatcactttttggaatcactgcctaaatattttgacagcgtctttgttggcctagtagtgatcagtatcattaccgtgcttctgattgtcttcttgcaaactaacctcggccaagccttcattgtcactggtgacaatcgtgaaatggcacgttcaattggtattaacaccgataacatgaccatcatgggattgatggtctctaacggtatcattggcctgggcggcgcattaattgcgcaaaataacggttatgccgatgtcagcatgggaatcggaatcatcgtaattgcgctagcctcgatcatcatcggtgaagttgtctttggtgaattaacgttgaatcaacgactcgttgcggttaccctcggcagtattttgtatcagttcgtgcgcctgttagtcctccaactgggcttcaacaccaacgacatgaacctgttatccgcattaattctggcaatctgcttaatgttaccgcaattcagtaaagttctacatcttaatcacgttttgaagaagggagtggcccgttatgacgaacagtagtgccccattattatcattaaaaaatatcgtgaccaaagttaatccgggaaccccgaatgaggtcaaaattttgcggggcctgaacttagacgtctatgatggtgattttattaccgtacttggttcaaatggtgctggtaagtcgaccctcttcaacacgatcagtggcgagttgccggttgatagtggcaccatccagttacgtgaccaggacatcacccgactatccgttgaaaagcggaccgctttcctggcgcgcgttttccaagaccccaagatgggcaccgcaccccggatgaccgttgccgaaaacttactgcttgccagccaacgtggtaagcgacgtacgttaaaattacgccaattgaaaaagcacctgtcccactttcaagccttaacggaaacgatggatggcaacggtctttcagctcggctcaacacggcaacagaaaatttatctggggggcagcgccaggctctgagctttttaatggctaccgagcagcgccctgatctcttgttactagatgaacacacagccgcactcgatcctaagaccagcgctcaactaatgacacaaacaaatcaacgggtcacggaggaaaagttaacgtgtctgatgatcacccaccatttagacgatgcgcttcgctatggtaatcgcctgattgtccttgatcagggccagattaagtatgatgttcgtgatgaggaaaaagcccaattgaccaaagaaaagttgctaagtttcttcgatattattgaataatcattaagtccatccctattaatactgacacccagtcatcaattttttgatgattgggtgttttttgcagctaattgtaaccgttttagttgtgaacaatttattttagtgctatattctaactagaatatttctaaactaaatggtgtcgacgggcacagctatttttcactgataatttagaataattacaaactgcccttgccgacaaacttagttcgtgttatattctatttagaacagttctaaactaaaatttggaggctttacaattatgaaagttattgtcgttggttcttctcatggtggttatgaaacggttcgcggtattttagccgctcaaccagatactgaaattcaatggtatgaaaaaggtgattttctgtcattcctctcatgtgggatgcaattatacctcgaaggtgccgttaaagacgttaactccgtcagctatgccactcctgctggcatgcaagcccaaggcgtccacgtttttgtaaatagtgaaattagtaaggtcgaccctgctagtcacagtgtgcacgtcattgaccacgccactggtgccgaacgtgatgaaacttatgacaaactagtcctaagtgtcggcgcggtaccatttgacctaccagtacccggccatgacttagccaacatctacgcaatgcgtggacgcgactgggccatcaaattaaaggccaagaccgttgaccctagcgttaagaatgtggttgtcattggctccggttatattgggattgaggcggctgaagtctttgccaaagctggcatgcatgtcacggttatcgacctattaccacgtttacttagtctttaccttgatcaagaattcacggatatcttgactaagacgatggccgatcacggcatctatgctgcagttggccaaggtattaaagcgtatgaaggtgttgacggccacgtcaccaaagtagtgaccgatcaaggcgaacatccagctgacctggtcgtaactgccgccgggattcggccagcaactggcttcttgaaaggcgttgtcgacttagatgatcacggtttgatcaagatcaacgaccacctccaaacgagtgacactgacatttacgccgtcggggacgcgaccttagtcccatttgccccaactggcaaggataaccgcattgcgttagccactaacgctcgtcggcaaggtcggattgccgctaagaacttacttggcgaaaacgtaccaatgcctgctgtttctggttcatccgcactttccgtctttgactaccactttgcttccactggtgttaaagaaggcacggctgacaagctgggcgttaagacggcatccgtgttagtcaccgataccattcggcctaaatttgtctctgaagatgctggcaacaccaaagtttggttcaaactaacctttgacccaactgatggtcgcgtgcttggtgcgcaaatcatgtcgaagtacgatgttactgctaacatcaacgccatctcagtggctattcaagctaaactgactgttgctgacttagcttacacggacttcttcttccaaccaggctttgaccgtccttggaacatcatcaacgtcgctgcccaaaaagcagccgcaaccttaaactaaatcaattaggccttaattaagccatgaaacatcaaacggatccctcagccacacatcgctgaagaatccgttttttaatgcatcaaaatgctagtcatcaagattgacagtataccaagtttattttcagatatcgtttcataaaataccatgctagacgttgtactagttattacttagcatgaatcgtgattaaaacgtgccagttatgtcagttcaaaagcagccagcttaggcctgctggaaaaagttcgagttagcgtaaaattacttagttggcgcgtcctacgccgacttccaggtatttcttccaattgctggaacgcggtggacacagatttaagccgcagaccacgtcttaaatactggtcttccacgctttaatgccatattggtgaaacgtgctcgggtcagactgagacttccggttagctacgctatgacgtcaagcggaaattcaccgcttaacgccctagctaggctaatcctcagtctcacccgtctgaacctcacactcttggcagtgctgagcattggccgaaacgccttccagtcgggacagtgttcgaatggcggacatggatgtacccaaccattgatggacttgtcattgctttttataaacgataactttgtcaatcaactgtcagacagaaaatgatattgtgataatttactattcccaaatcaccatagtaataattaaacgtctcgacaaagtggttaacgccaccctaacgttatgtttaaatttccagtaaaaaattgtaccaagttaagtggctgttcatttgccatttgagcggcttcccgactggaggggctgggtgacaatgctcagtagccaaattattcttagctggaagtgtttttcttcaggcttagaataagactcgtatttgagatgacgcgggttatgcgttaactcaaatcgacgtcggctgcgttccagcaattgtcacccagccccggaggtcggcataggacgcgcaccggctgacgaacagtaatttaactggcatgttttaatcacgattcatgacaaattaactcgcataatgcgtatcatgttaataaaagacggggattcagaaagattaaactcgctgaatccccgccttgataactattatttcaataaatatatgatgtttgagcgactttcatcaagtcagccacgcgctaataaatattaatcaatccctgagttccttgatcacccaagcctttgacatcgaccattacttcataaagtcgtttagcctgcgccgtcgcaaccagattaagtcccatcgcatccgcctcactcaaagcaatccgcaaatctttaagaaaatggcgggcaaaaaagccgggcgtgtaatcgtccttcagaatccggggcacgtaattatccatgctccagttgtcagcaccaccgctagataacgttgccaagactttttccggatcaagaccggctgccttggtatacaataacatttcagttaacccagtcatcgtccctgcaatcatgatctgattggccattttggcatgttgaccagtaccagcatccccaaaatgattgaccttgtgaccaagcacattaaataatggtaacatcgcctcgtacgtatcggcatcgccaccgaccatcaccgtcaaagtggcgtttttggcgccaatatcaccgccggacacgggcgcatccaaagcgtgcatgtcatgttcacgcgcgtacgtcgcaattttaacggctaacttgggttggctcgtcgtcatgtcaattaccgtttttccagcggccaatccactgaaaatcccgtgatcaccaaaataaacttgttcgacgtcccgtgggaacccaaccatggtgaaaatcacgtcactcgtttctgccacggcagccggtgtatcagcccaagtggcccccgccgcaactagcgcatccgccttactttttgttcgattataaaccgttacgtcatagccggccgtcatcaggttacggacaatcgctgcccccatgacgccggtaccaatccaacctaatttcatcatttacgcacctttccttccacgcactgttcattgcggcgccgacgccaaaaatgaatcagcaacgtaataataaatgctactaatacgataccaccaaaagccgttgcgggaatatcccaaccaatggcaggaattgaaataaataatttgatggcaatcaagacaatcaagcaatacgccatggtttccaactcgggaatcttgcgcattaagcgcataatgacctcggcaatgccccgcatgcaggcaatcccaatcatcccaccaatcaaaacaatcaccggattatccgaaattgccaatgacgccaatacagaatcaattgagaaaatgatatccatcatttcaatctgaatgacgaccgaccagaagttgcttagtccgaagaagcgtcgttgttgcttgggtttctgtgccaccttggccccatttttcggctgactaaagtatcgatacaccaagtacccaaggtaagccgcacctaacactttgatctcccaaaaactgatcaaatacgtgccaatcccaatgattaaaaaccgaaagatataggccccccacaagccatagaataacgatttttcccgctcttgtaaattatctaaactctgggtctgagcagctaagacaacggcattatcaactgatagtaaacactcaataattgctaacgataaaatgattaaccagtcattagcagatgtgatgacgttaccccagttagtcgcactgaagaagggtccatacaactgttcgattaaatataacaaacggcatcctctttctcttaatattagtttgttaatctaagtatacctgtaaaaataattggtgccgcttacgtggactaattttcaaaaataaaccttattttcgtcgtatttacgactcatcatgccaatgagtaaaataagtgcccaaaaagctagccaattgcgacctttcttattctaattgtcgaataactttggctggtaccccggccaccaacgtattatcaggcatgtcatgagtaacgactgctccagccgcaatcacaacattattaccaatcgtcacgccgggcgtaatcaccgctctccccccaatccaaacatcatgaccaatcgtgactggatgaccctgggccaagctagcacgtcgaccactagccgtcaacgggtgattgaccgtataaatatcaacattggggccaatcatcacgttatcccctatatgaactggcgcgatatccaaaatagttaagttataattactaagaaaattatcaccaacatgaatattacgaccattatcacaattaaagtctgcttgaacggaaagattgcgaccgtaactaccaagaatctcttgaatcttggcagtttgcgcatctggatttgttgcatcgatctgattgaactcttgacataacttggcagcccgcgctttttgagcggccacctcagcatctttaaattgataccattccccagctgctaatttatctaattctgacattgttgtccctcctgtattttatcaccctaattttactgcttagagtggcgtcgaagtcaacacttgagttaatggtttagcaggtgttattgacaactatccttgcggaccagctgcctcgaatttattcagcagttagggcaacaaaaaaagaaaccgattactcaggtttctttgcgccaattctaggccttaaactcacgaattaattgttggagttgctgattatcgttagccgttccgaccgttagtcgtaaccaccctggccgtaagccagtgcgaatcagatacccatggtgcactaaatagtcagccagttgcgtggcactcggatacttaaagaaaatgaagttcgcgccagattgatcgtaagtgacaccctgatcatcaaagaatgccatccacttagcacgttccgtcgcatttttttggaccgtttgtttcacaaaattaggatcatcgattgccgccagggctgccacttgagccaaggaattcacattgtatggaagccgaatagtttgcatcgttgcggcatatttggtattaaaaacggcgtacccgattcgaaagttagctaacccatatgctttggagaatgtccgcatgaccactacattcgggtacttggctggtaactgcatggccgttacttgagccgcgcccggtgtaaaatcaatgtaggcttcatcaatcaggaccatcgtctccggggatacttgctggacgaacgcttcaattgccgctaatgattccacggtgcccgtcggattgttcggattgcacagccaaaccatcttcacgtggggcgtaatggccttcattaagccttcgaagttcacatggtcattaggcaacgttggcacactgattaattgccccccctcgatctcagcatgtagtccatattctgaaaacgtcggtgcggacactagcacctggtcgttggtggctaagaacgtccgtgataacatcacgatcatctcatcaagacctacactaaaaacgatgctattcgggtcgattccctgttgctgggccactgcttgtcgtaactcctgtgcgtcggcatcgggataacgattactctgggtgaagtcccaattcttcacagcgatcgccacttttggcgaggtgccatacgggttctcgttagctgataaccggactaattctgtcaatcctaactcagcttggagggtcgccaacggcttttcgggcacatagggttctaactgttcaatactagctttcattcggctacctcctataggttcttaatttcgggccgatccttatagtcactcatcttaccttcacgtttagccaattcttgcttaatctggtcaaaactaacaccacgttcgaccaataacactaaaacgtgatacaacaagtcggctgtctcataggttaattcgtcgtcaccgggatttttggccgccacaataacttcggttgattcctcaccaaccttttttaaaatcttatccagtcccttagtaaataaataatctgtgtaggagcccttcttaggcgttgccttccgttgtttgatcagttcgtataattcttccatattttgcatattcgacaccactttcttctataatatattcatcaatttaatacgggttaaaaacaatcctgcttatcgaccgttgggaccgcattttccaaccaatcagccatctaactcccaactcattcggctatcgtcatcaatccttaggcgccctgttctagttcaaccgggttaaagaaacaactcgtatgtcccgtatgacaagcgggaccatgcggatgaactgcgaccaatagtgtatcttgatcgcaatccaacgtcatactaacgacatcttgtaaattgccgctcgtagcgcctttgtgccaaagttcttgccgagaccgtgaccaaaaccacgtctggcccgacgccaatgtccgttgatagctttccgcgttcatccacgcgaccattaagacatccttcgtatccgcgtcggtgacgaccgttgtcagtaagccgtcacccttttcaaagtctggtttcatcttacgaccactccttgttttcttaatgtcgctttgacatctgcaatcgttaactcgccaaagtgaaagacggaagccgccaatgcaccatcaaccggggttgtgctaaaaacatccacaaagtcttgtaagttacccgcaccgccgctggcaatgattggcacattgaccgttgctcccagggcctgatataacttggtatcaaaccccgccttagtgccatcgcgatccatgctagtgaccaataactcgccagcccctaaggcgaccgcttgcttggcccacgccactgcatcgaggtcggtcgcttgctgacccccatgtgtatagacacgatattgaccagctgccgcatcccacgccgcgtcaatcgcaacaacaatgcactggttaccaaatttttcagcaccggcacgaatcagttcagggttggcaactgcagccgaattaatagccgtcttatcagcacccgcacgtaagattcgttgcatatcagcaacgcttgtaattccgccaccaatcgtcagtggcatgaagacctgagctgagacttgttcgaccatggcggccatcgtctcgcggtgctcattggtggctgcaatatctaaaaagacaagttcatccgcgccctgttgctgataggcagctgcaatcgccaccggatctccgacatccgtcaagttgacgaaattaacgcccttcttgacccgaccatccgccacatccaagcacggaataatccgctttgctaacattcagtcacccccgctaattcggccagtgtcacaccgccttcagctaacgccttgccaataataacatccttgaacccactggcttgtaacacttgaacatcggtcaaattccgaacgccaccgctggcaatcaggttggccgtgggcacctgtgcttgtagttcttggtataacgcaaggttagggccttgcatcgtgccatcacgggcgacatcggtcacgataaagtgcttggcaccactcgtagtcattgtcttcattaatgtactcatcttggtctgtgactgctccaaccagcctttaattgccacataaccattggttccgtctaacccaatcacaattcgctcaccaccaaactcacttaacagtcgtttgaccagtcgtggatcagtcaacgcaactgaccccaagattaagcgatcgattcctaattcgagataacgagtcgccagctcgtaggttcgaatacctccaccgagctcgatcgtcccggtaaatgcttgccggatcgccgtgattgtcgcgaagttttctgggcgccctgacttggcaccgtccaaatcgaccatgtgtaattgctgcaagctcgctgcgttaatttgttgggcttgaacgacaggatcaggattaatcaatgtcgcctgtttaaaatcaccttggtagagccggacactctgaccggctcgtaaatcaattgctggaaaaatcatttgcactcaccatttccttaaaagctgctagttgttgtaatccgactcgaccactcttctccgggtgaaactgcatcccaatcacattttgatgctgaacaatacttggaacctggacgccgtgttgaactgtcgccacgatttcagttgccggacataccgcatagtacgaatgaacgaagtaagtataggccgcgtcaatactggtaaagggactatcaggacgccgaagctcgttctgattccaccccatctgtgggactttgacattcaagtccgttggcaaagcgctaacccggccgcttaacaagcctagcccagcatgcttgccgtactcggaactactttcaaacaagagctgcatgcctaagcaaataccgagaacgggtttgccactccgcgccaatgcttgtaacacgccgactaactggcgttcttttaaagcggccattgcagctgcgaaagctcccacaccgggtaaaataactgcgtcagcggccgctaattgttgcgggtcagccgttaagatggttgacacttgcaggtagtcaaaagctttcttcaaattacgggtattacccgtatcataatcgacgattgcaaacatttaaatcacgcctttcgtagagttgaccccctgaatatctggattaatcgtgacagccgcgcgcattgcccgcccaaacgctttgaacaaactttcaactttgtggtgagtgttacggccgtacaggatgcgtgcgtgcaaattcatttcagcagcaaaggccacggcttggaagaaatcttcgactgtctccgtatctaagccaccgagccgcggattcgtgagctcggcatcaaaaactaagtatgaccgtccacttaggtcgacactgacctgacctaaagtctcatccattggcacaaattccgtcccgtatcgttcaattccctgcttatcacccaacgcctgcttaaagcattcgccaagcacgattcccgtatcttcagtagtgtggtgcgggtcaacgtcgaggtcgccgtgacacttcacgaccaacccgaagcgcccgtgcttcgcaaataagttcaacatgtggttcaaaaagcctatcccggtatcgatttcgataccgctctgttcgtctaaattcaaactgatttcaatctgggtttctttcgtttcacgtttaatcgttgcttgtcgcatgttcatttcctcctcatctgctaaaacgactaccggctgtaatcacaatcagtatcaactactaattacgccctaatcgtaataggtgtcaaaacgactctcaatcgcacgagcatggccttccagaccttcgacccgtgccaacgtggtaatcgccggagcttccttagccaaagcgtccttagtgtattggataaaggacgttcgcttaacgaaatcatagacgccaagtggtgatgagaaacgggccgtgccactcgttggtaagatgtggttcggaccagcaacgtagtcaccgagtggttcagaggcgtagcgtcctaagaagaccgacccggcatttttgattaaattcaagtactgagttggattcttcaattgcacttccaagtgttctggtgccaccgtattcatcaagtcaaacatttcttcaacctttgcgacaacggcaatgaagcctttttcgttaacagcgtcggtagcgatcgcttctcgtggcaaaactttcaactgtgacgtcacgttgtcactgacggcctgcgctaagtcggcactatccgtaattaggattggccgggctcgacggtcatgttctgcttgactcaataagtcagccgctaattgccgaggatcagctgaatcatccgctaaaataccaatttctgacgggccggccaccatgtcgatcgccacctgaccaaagacctgcttcttagcagtcgccacaaaaatgttcccaggaccaataatcttgtcgaccgctggaatcgactcagtcccataagctaacgcagcaattgcttgagcgcctcccacttgatagatggcgtcgacgccagcgattttggctgcagcaagaacggctggattgatgccatcgacttgtggtggcgtcaccataatgacttcattaacgccggcaatcttagcgggcaaggcactcatcagtaaagtcgatggataggctgccgtgccacctggaacgtataagccaacccgattaagcggcattaacttctgccctcgtagaacgccaggctgttcagcatcaataaagccagtcgccttttccttttcgtgaaaactcgtgatattgcgtttagctaacaacaaggcgtccttcacttgcgggtccagattgttataagcatcatcaataacagtttgtgacaacttaaagtcggtcaaggtgaccttatcgaattgggtttcgtaatccttgacggcggcatccccgtttttaatcacattggcaataatttcgcgaaccgctgattcaacctttaagtcagtcaattgttgggtcttcgtttgaactaagcgttttaaactagctaaatcttcattaataattttcattagacaaactcctttggattattcgtatcaacaactgtggccaaccgatcaactaaatcaaagatggcggcttgttgctgttttaaggctaaccggttgaccactaggcgggtcgagactggttgtaaatagtcataaatttgtaaatggttctcacgaatcgtggtccccgtctcggtgatatctacgatggcgtcggctaagccagtcagtggtgctaattcaaccgagccttcaatcttaataatttcaacatcttggcccaagcgatcaaaataccgttgggtaatcaatgggtacttggtgccgatgattttgcgtcgtggtgcaacgggatcaaagtcggccgtggatgctagcacaaattggcacttaccaacccccaagtctaacagttcatattgggtactctcgtgttcagtcaaaatatcgctaccaacgatgccgatatcagcagcaccccgttcgaggaaggtcgtcacgtccggccctttcgctaaaataaactcatatggttgcgtctcagaatcaaaaatcaaccgccgttgcttgttgcggacttgcgaacaatccagtccagcttcttccagcaacggcaggacttgttgttcgacgcggcccttagtcaaggcaatctttaaacgtggttcagtcattggtcatacctccagttaaatcaatcagttgggcattcaaacgttgtgcttcgatgcgcgcacctgctaagtcatccgccaaactcaaaatggcgtgcggttgtttcgctaagtatgcctccgcttgtgaccactgttcaggctcaaagtaaatcaattgttcagcataagcggtctgttggtcggtggctaaagttgttaacaagtcaacgtttaaccccattcccacagccggttctgcttcagcttgaaagttcgttaacagtttgtcgtaacggccgccgctgaacaggtagccagcccccgcttgtgaataaccccgaaaagtcaggccggtatagtatttttgtggtgcttggctactcaaatccaccgagatgacttgctccggcatcgtttgttgcatccaggccaccaccgtttgaagccgtttcagacttggttggactgtttcaggtagtggtgctgccgctaattctttgaagatacattctggacgcccgaacaaacgcggccatgctttgagaaaatcgtataaaggctgtgcgcggtacttggcaatcaatttcgtgtagcatggtacttgcttatcgaacagtgcggttaaaatggcttgttgttcgccttcgtcaccagtcaagctggccacgacccgttgtgcaaattgggcatctcctaattcgatttcaacagcatcggcaatcagctcacttgaaagctggttggcaatcgttaaacattcaaattcggctttcagcgatgcgtaaccgactaattcgactcccgcttgtgtgatttggttatatgaacctgataattgacggcttactcgaaagatatcgccgacataaccaaacttttgcggtaaggggacattcgtcgcgctaatgaagcgagcaactggtaaggtcatgtccggccgtaagaccaaggtgcgaccatcgttgccaaataagcggtatagttggtagttacccatctgatatggatcaaacaccgcttcgttttctaataacggcgttgcaattggcgcgagcccgcgttgtttaaaatgggcttggaccaccgcgatcaagtgttgtttggtacgtgcccgccgaccaaattcatcccgggttcctagtggtaataagtgtttcaacataatttacgcctcctaaaacgtcgttatttaaaactaatcagtttaattcatatcgttacttatcaacgtgcttaatcaattgcttacatgctaaccggagcgacttgcgattccgtcacgcaaacttaccgcatggatcggtgaaactaaaaaacgcccccttagcaatttgctaaaaggacgtttacgcgtggttccaccttatttcatctaccgttcgcacggtagacctcatgttgatcaagtcaacttggataacgaaaccaattcggctaaggctaatgagactggttcaccttagcagttcatagatgtgtgttcgttaagcctgtctgtccggttctcagctacccgggctctctggatgaggaagacttaattacttgttctaatcacaaccgtttattaaaatttgattagtcgtttaatttataattcattgtaatcactaaactgacggctgtcaaccctcaattaatttttttataagatgatagccacgccccacactggctatgtcatgggcatcagagccataaaccagcggaatgtcaagcttttgagcgcgttgtagaatctgttcaccgggataaaaatcattacaatacggtttgtagagaccagccaaattcaaatctaactgccgccgttgctgcttcactaacgccaacgtctgatctactaattgaagattatggacatccaagggttcagtcaagccaaagtaatcctgatatttgcggacgagactcatgtggccgatccgttgtggtgcgtaagggcccagatctgcttgtactgatgccaagaccgtctgataatactgttcaaaaacacgttggggcgtcttaagccactgcccaaaaccggctgcaaaatcatccgttgacatgtcaacacaccagaaatgctgccgtaacccccgcatgaaatggactgacaaaatactttcctgcgtccgaggaccataggtattcagaaaatcacgcgtccaagcaacatgctctggtaagaaatcaacttcaaaacccactgagatctcgatttgcccggcatatttggtcttcagtccgttagccagtgccaaataatcggctacttggttctcacgcaacgacgcctcagtataaccggccggcgtcccttcatactggtcacgaaatgccggtggtaacggtgcgtgctccgtgatacaataccgctgaaaacctagctgtatcgcccgttgaatcattttttccgttgcttcaccactcccatgcggacatagttccgtgtgggtatgcccatccattagcatatcctcatcaccctctcataatttatgcttatggtagattgtaaaattaatccgaacgctgttcggacaaaaaagatcagcttcctttaaaatggtgtttaccacaaacacatcttttaggagctgatcttttgtctagtataacctattctgaacgaattaaaatcgaaaccttttgtgaactaggcctgtccaatatccaaatgagcgatcgcctaaaacgatcacctgccacaatttcttatgaattagctcgatgtgaaccttaccaggccgaaatggcccaaacagatgccgaatacaagcggtcacgatgtggccgaaagactaaattgaatgacaaattaaggcaaataattttaaaccatttacggctaagttggtcaccagaaatgatagctcacgaatttaaactagcgactaaatcaatttataattggttaaatcaagggaaaattgagttttctttaaatgatttgcctgaacatggcgtgcgccaacggcgtaaccttgaccaacgttctaaatataatcaatcattaggacggtcaattgaacagcgacccatcgtggttaatcgacgtaatcgcatcggtgattttgaattagatacaattgttggcccccgtgggcatagtaaggcagttttattaaccttaatcgatcgcaaatcacgtttcctttgggcctaccgattaaaaaaccggacagcaggaactgttaatgaagccctaaataagtttctagcaacttttaatggcccggtgcatagttttacggtggaccgtggcactgagtttagcggtctagtatcacttgaagcacaatacggtattaagacctattactgccatgcttatacgccagctgagcgcggcagtaatgaacgatttaatcggaacttacgctatttttatcctaaggggacttattttgagcacattagtgctcaaggcttgaaaaccaccttactcgaaattaatcagagaccacttaaaatacttgactggcaaacaccttatcaggtcatgctgacaaatttgtccaaaaattcggattaaatttgcaatctaccttattcaatcatattttttttagataagcaagtatggtcgaaacggtcattcgcgacaatacgctagcagtcacggcgaaagtctaacaatttacttatttatttatattaatcgtcacaatttctttataccatgatatagtcaacgttagttaaagaacagcgctattcccaaaaaaggggggaccggccatgcacgaactcattacaaaactttatcaactcgcactttccagtcacattgtcagtacgttgctggaacccgtgcacatcgttatcttagctttacccatcatgaccttactactcgccatgattatcctgactatccagctccgaacacgtcaaacactgagtgagcgtaacttgatcagtacctattcgtttatttggtacttggcagcagcctacttactaattattctgccactcccgactcgctcatccgtggctagcctaacaactgctgagtataatttacaacccttctactttctcacccagttgaaggcactcacgccgtttgaactcggggaccccagtacttggttagccgccttcaaatctgacacgttcttccagccgttcttcaatattctattatttatgccgattggtgcctacttaaagtggcggcaccgctggccgctctggttgatcaccctgacgagcttctcgatttcattgttcttcgaaaccacgcagttaaccggattatacggctactactcacgagcctaccggatgttcgatgtcgacgatttaatgatgaacacacttggtgggattgtcggtgctgggtgtctacatctgattcctaaacagtggcgcaatcgcgaccacagtacccggttgaattggcaggaacaccccatcaattggcgccgcattggggcgttggtcatcgattggctcgcaattgccgcctttgacaccgtctacttcgtcttagtcaaacattttaattggccattaccacatgattttcgctggctatacctggccgatatcatcctcttcttcattgggcccgcctggtgttggcatggtaaaaccattggtggtcgcctgctcaatagtcagatcgtaaccatcagtgatcaccaggccaatctctggcaactgcttatccattacagtgggctctacctaatcggcctgccacttttattcttggatttatggttattcaatcgtctaggcaacgttcctagtgccacccttaaccgcctggatgtctaccttgtcgtcgtttcagtcattttactgattatcagttatgatttattgttagcgcttttcagtcgcagtcaccagttatggtgtgaaaagttaagtagaacaactgttaaataattaggtggccttaaaacttcctttgcgttgtctcgcaactcatgttaaattgaagatatctcaaaacgctggaagtaaaaacaatgataaaagtccatgaactaagcgacgattttcgctgggtcgctgttaataattacactgaaaatgattatcatcaactcgtaagtgaggaacacgttaccgacgaaatgttaggctacgcaaccgatcaacacgaacgaggccggttggaatatgacgccaaaagtgccatcacgaccattatttttgacgtggtcacagaagacgttgaggaaggtacttataccgcccaagtcagtttcatgttgattgaccacaccctactgacttttacgaccgataacacaatattcgttgaggatatgttggcagacgaaatcgatgccgattgggaagatgtcctgcatccatacgaccatatctttaacgtcttgtacaagctatcacggcaatatttttcggccatcaacaagatcaataaacaacgccaagacattcagatgaagatgaaaaagcaaattcagcgttcagtcattattcaattgatggacttagaaacaacgctagtctatttcctcacgtcccttaaaagtaataacgacatgttgcagtcactcaaacggtttgtaccggtcaaattctcggcggcccaattagaacggctcgacgatattattgtcgaggcacaacaaggattggaaatggccaacattgcctcagacatcatcggccgggtgtcgaacgcctactcgaacattctagacaacagtttgaacaacacgatgtgggtgctgacgattttctccatcgtcctgacaatgcccaacattgtcttcggttttttcgggcaaaacgtcgatttaccattcatgaagaatccattcggttgggagattacggtattcatcgccgttgcactatgtgccctaaccatttggttgctacgacgcaattcatttcgaaagtaaaggaagcttttactcatgcctaatcgtccccaagtgactgatacgacggcctacattaatcaggttgccgaagcggcccaaccaatcctcaataatctcgtgcagctgattaccactgaactgccggattttaaggctagaattaaatggaacttgccgttttacgaacgtgacaagcactatgtcagtatcgccgcttacaaagcccacgtcagcctgagcatctcagctgatttggatgacgccacactagccgctgctaagtccgcgggctatccaaccgggcaaaagcgcctgaatctgccactgacaaagccggtcccgacggcgctcgtacagcaagtcttgcagttgattgcttgacatgcgtttaacttatcgaactgaccttcacgacccaaatggcttcaccaagcaacccgcaacttgattttcaaagcgtcgttaattgaacgacgatgcgttaagactaccggaattctatgatatatctcagcgaaaatcattaaaatataaaaacgcgccagcttgaaacttcattgagctggcgcgttttcaattggggtatcatttccgtgaactaccgacgacgtaaactttagtccttgacgttcgcaaagtgggcaagttcctcaagctaaccagacgctttcaagtgccggtcatattcccggtctagatccggtcgcacttcagtcgtaccgggaacgaagtggatatcctcatgttccgcctctgtcgcggtctgataggaccactccttcgccagattctggcttggaataactgctcgcttgaacccccaaatgatgcctgcaatcacaacttgatccggcgttacagacatcattggccgcgtgtctgataaccacgtgaatattctgacgcacaattttgctgtgagtatcaaaaaaagctggtcgccagaattaatattctagcaaccagcttttcattacccttaacaaattagttttattgcatgtgcaataaacccatcttgtccatggtttccgcaatctgaactgagttccaagcagcaccctttaagaggttgtcggaaacgttccacatgtggaaggcttgtggcgtttcttggtcaggacgaacccgaccaacgaacgtgtctttagaaccttccgcattatgcgcttgcggataaatttggttatcagggtcgtcttgtaagaccacgcctggtgcagctgccaaagcatcttgaatgcccttgacggttgccttaggatcttcaacttcaaagtaaactgattcggagtgactcactggcaccggaatccgcacacaagttgccgttactttgatatccttactgtccatgtcgccgccacacataatctttttggtttcatggatcatcttccattcttcatgggtgtagccatcttcttcaaacacgtcaatttgtggtaacgcattgaaggcaattggataatgcttcttgtcgcccgcaacaggtaagatatgagcttccatctcttcaccttttaagtaggcttccgtctcatcatgcaattccttcaaggcccggttaccagcaccaccaacggcttgataggttgaaacaatgacccgcttcaaaccaaatgccttgcgcactggttccaaagcaacgaccatttggatggttgagcagttcgggttagccacgattccatgatgaagcttcaatgcttcagggttaacttcaggaacaactaacggaatctttgggtccatccggaaagcactcgtattatcaacaactacggcaccccgtttgactgcttcaggggcgaacttcttagatactgagccacccgctgagaagagggctaaatcaattccttcgaatgattcaggaacggtctcttcaacagttaaggcttgaccattgaactgtaattgtttaccggctgaacggcttgatgccaaaagtttaactgagttgacaggtaaactcgtctgttccaccattttgatcatccgcgcgccaactgcaccagttgcaccgacaatcgcgacgttatatccactcactatgaagacctcgctttgatagttattgaaacctcattatagcacgtttgtaaagattagaaaataatgagttccatccgaccataaattaatctgtcactgattgcactgccagctgttttgcacacgcagatcatcaaaaaagtaaccgttaccatcgttaattaaacagtcatttagctgtcgcccattttgacgtataatgaacctaattcaaaggaggccgcgccatgtgtaccagcttaacttatcttgatactgacaatcaccgctacttcgcccgcaccatggactttccaacaacgacaccttggcggccaatttttttgccgcgccgttatccgtggccaactgggttagcgacgacgcgtatgacgcagtatgccattctcggtggtggtcggctacctgaccactttaaggcttgtttgatggctgacggcattaacgaagctggtttgatgtgtgctgaactgtacttgccccacgccgttgaatacgccactcaaccacaagtcaaccaaattaatttaacacctcaagccttcatcaactgggctttaggtgaacaccaatcagtcgcagccgtgatcgccgatctgccaagtgttaacctggtcggtgcgtcctggggtgatgacactggtgaagtctatccctttcactggtatctcagtgatgcacacaccagtgtcgtcatcgaacccactggtggcccactgacggcgcaaccgaatccagccggcgtcctgaccaatacaccagtcctaagcgaccatcagcgccgactaaatctttatttagcaatatctggcaaccagattacaactgccactcgtcaggctgctcagcacgtgattcagactaagcaaccattaccgagcgggccgattcccactgatcgtttcattcacatggcacttcgacgactgggaacaccgcagttagcaccgcaacaagtgccgaccactttattccgctggttacaagaagtaagcttgccataccacgccgaccgtcgccatctcatcagccacaactacacgcactatcgttgtttgatcacgttagcgactcgtacttaccgctttattccacgcacgactggtcacgaacaacgactgacactaacacctgaaatggcagcaacctggcgaacaccgtacctcttccctgccgattgaaactaaaaaatcacgatgttgagactgaactcacatcgtgatttttaattaatgacgctgcttcaaaaaatgatcaaattcctgattgattgccgctcgtacttggggctcatgtaaatcagcttgcgctgcattcggaccacccgtaacttgactaaccacttgcaaatagccgaacaagacctggctgggatcaagatgatactgcttggctaacgtcacggctagatcataacgatcaggtcctaataaacttgaataatccattatgccgtccctcccttcgcctgttctagctggcgactcatccgtaagtaggccaaaaagtgaaaaatgatgccacctgctagtaagattgcacctaaccataccgaccaaaacgttgccacgatggctaagccataaatcgtgacacttcgaaccggatcaaacttaattgcggcataaaaagccattgagattcccggcttctttagatcctggtgatgatgcagataagcgtacatgaaataaaatgtcgccgaaataaacagggcaaccaaatcataaacgataaatgccgtttgcatatcctgtcgattaccagttgtcaacgcatctgccactaatgacatcgggtaatccaataaggtgatactaaagagcattaataagtttagcatattaacgttgcgatcaattcgttgtagcatgttgaaataatcatgatgaaataaccacagcgtgccaacgtagaaatacgaaaagacgtacgacaagatcaacggccattgcgctaatagtgccgccagtaaatgtcccggttggtaatcgggaatgtgaaattctaagactaaaattgtaattaaaatggcaaaaataccatcactgaacgcctgaaatcgatctgttttcaaaatcagcacctcccacagcgttttaggataccataactcacaagtaattactgtaattaacttttcaaactgacgaccaaaccgcttctctaacacctgatatggtaagattaagtcaaaataaagtaattgatgtgggggcgtcaagacgaatgcgaaaattattaaaaccaaagtggttgttcttatttttctggggaatcgtggtgtttgcaagtattctgattttaccgaacattaccacgtttgtgaatgaacaaaccgcaatgccacaagatgcaacaacgagtcctaaatatcaacaacaatggggtcacgggttaaccaacagccagtccttaacgttagtcttcaacaattcaaatggtaaattatccaaacagcaacgccaacaaatctccacgaccctagccaaacttaatcgccgagccgatgattatggcattaaccagcttcgaacgccaaccggtatgactaatgaccggcacttattacgttccaatgatggttccaccgaattagcccttgtcgccgttcagacatcccgggctgacctatctgtgattgcaaatcaacttaataatgcgattgcaatcgccgacctcaatacgagtgtcaccagtacggacttgatctaccaacaacacgtgcaacaacaacgtcgcaacttgctgattagcatgcttgtcggtagtctgctcagtttaatcattctcggcctcatcttccgctcactgttagtgccattactgaacttactgtgtcaagtggtcactctgatcacaacgattagctttatcactaacgcgcgtttagcttggcattggccactgacggctaatgcgctgagccttgctggtctaatcagtttaatgctgactagtctattgacatggcactttatgtacgcgtattggcaatcgagcgcaccaaccgcaccgaccactgtcagtctcaaaattctgacacttcaatatcgacagtgggcacttgtttttatcccattaatactcataaccatcactttacactggactgccttcatctcattagccgatgcttgggccattactgtagcgcttggaatcaccttactggcggtaccgccgctcaactacgcctttaccgcttggctcggtgataatttattttggccaggaacaacggcttggccgacccgtccacgcaatctatggggccaattgagcaagttcggctactggcagccagcgcttgggagcttggccgtcgcactgttactactccccggcctaattcttgctaacggccagtttgccgatgacaacttacgaccctggcgccaaaatcagcttagtaatgctgaattaggtcagcaattagtccaagctcacttcggtaccggtgccacggcgccaatcacaattacactacgagcaccgcagaatttaacgcagcagcaatcattacaaacaatcgatcacctgacgactaaactgcgggccgtaccaaatgtggctcaagtcatctcagtgacccagcccaccggccaaccactaagtaatttctacgttaaccagcaacttgcgactatcaacattgatttggctggtaaactgacgagtatggcgaaactcaagagccaactcacgactgaccaacaaagtctggaacaagcagcgactagtcgccataccaagtcggtcgaccagttgtccgaccgcatcaatgatttggctgaactgaatgatcaagtgcaacggcaattacaggctattgacacgacgctaacgacatcagctgaggctgaacccgatttaaccaaagtcaatcagcaggtcaccgagttagatcacctgactgaccgcatgacaaccgcactaaatcacgtggtaacggcccaaactacggtcgcaaccgaagctggacacgttgatcagcgtgttcaccacgtcaaccaatcattgaagcagaccgttcaacccttaaccaccttactcgcttcactgaaaaatacgaagacctatctacatgatttagccgctagtcaagttggccggagtttttacctgcctgctaacgcggctactaatcaggcctatcaaaacagtctttttactaatattagtagtgatttaagcatgacacagctaacggtcactttgaaatcagcgccggctagtgcggctagtcgcaggaccctgcaacgacttcaggcagtcacccacgacagcctactcgccacacccttagcgcacgccaaaatcctaacaaccggggtaacacagcaacagcactatcagcataccctgattgcgacccacgcactgagatggctcacactcggattaatcatcggcatagttgttttatggttcggcctgcgttcattgaccttcagtctgttaatgaccgcgtgcttaactggcgtgacgttaactagttggggttggacccagttaatattaacacgctggttgcaaaccgggccgctcagtagcagtgtcttgcttggtagcttgatgttgttgacactgcactggctaatgattaccaccgcaaccggttaccgtcaaagttggttacggcacttggagcccgctcatctgcaacagcacttttatactagtggacgattcgtttgcccggtaacaatgattgaattgacctacttactgccactgcttttgacgaccgcaccaaccttaaaggggcttgcactcatgagtctcattgggattacgataagtaacctcatcgttccattgggattttcagggtggacacgttgggctaatgagccaccagctatagccacgctttggcagcactttcgcccatcatctaccaaccgctagcaattagttagcctaatctttgagtaaaaaaagttgcgtttccagacgtcaaatctggaaacgcaacttttttacaatactaaattgaatcgtagcaaactgccagtcgtttatacttaatgattgtgtgagcaccggtaatctgatagtcaccgctgactaactcaatatcgtcatactagcaacgacaaagactaataaggtcatcgccatccgccattcactgtgccaaagattttgcgtgtgccaccacacggctaacaatctccacatcagctagctagaccatattgcttaatcgtaactcacacgatgattcaaatttattgattgaaattctgaactgaccccgtaaacaatgttagctctacacataaccaaaacaatgccccaaaaaccataaaatttctggggcatcatcaatccctacatgatactttaataaatcaattcatgcgtcttcaagcacgacggcgataaccgattcccaccgcggcaattaacaagcccaaaagcccggcaaaaatcacccaaatcggcgactgcttctcgctggtttgcggcaaagttccgtgattatagccagctgatgtgctttggtcactaccagttggcgttccaaagccgttcataccagttgtcacaccattacccacagtgccaccagcaccattgacacccgtgcttggttgcttgatcagtcctggtaatgccggttgacctaatccagattgtcccggtttaggtgcagcgggttggcttggaccgggtacagctggtcgttccggttgtggcgcggttggccccgtggttccagggttacctggctcagtcgttcctggttcgcctggtttgcctggttggcttggttcagttgttcctggttcacccggtttacttggctcagtcgtccctggctcacctggtttacttggttcagtcgttcctggttcacccggtttacttggctcagtcgtccctggttcacccggtttacttggctcagtcgtccctggttcacctggttggcttggttcagtcgtccctggttcacctggttggcctggttcagttgttcctggttcacccggttggcttggttcagtcgtccctggttcagtgactggttcatcagttgctgctaccgttaccaccgccgtttgatccggcttgattgtaaatggtaacggtgccgcattaagctgatagccactaggcgctttagtctcaacaaattgataatcgccagcggtcaaaccaaatacagtaagttgacctgtggtatccgtcgttaatcccgtcttgagcactttgccagtggcatcttgcaattcataaacggccccggctaatgccgccttggtcgtggcatcagtcttggttaacgtgacatcaccagttgtcggcacaactggttgcttgacatcatcctgactcacctgaaaagcaacttctggctcaataccgccgagagtaaattttactggggtggtattcaattcatacccaagcggggccttggtttcaacgaactgataatcaccggcacgtagatttttgacaatcaattgtccctgcgaatcagtcgtcaacccagtttggattaccttgcccgtactatcttgcaattcataaaccgctccagccaacacggccttggttgccgcatcatgcttcgttaattcgatggtataagtcatccctgctgttccgttaccaccataggtaatatcggccgtcgcatcaacacctagtccgtccaatgcagccgtattacgccatgcaacggttttagctggatcaacattctcagttttagtgttataagtaattacaaacggcgaattaatgttgttaagcgtaaaagtaatcacgttaccattaattgcaacagtcggtgttaacggttgctgtggcacttggataccattgataatttgcacggcctgtgccgcgaccgaatctggaatgaacgtctgatcgggccctagcgtatctgtaaccacaaccgtcgagttatttccgggtgtcacggtaatgtgccagcccaataccgctggcgcaccatcactcccggacgaaacaaccaagccactttttgcaatttcagctgatccttccgtcgccgtcgcattgcccttcgcattcatgctcagtgtgccagcccgaccattgagtgtgcccaacgcatccgtaaacgtaatcgtcccagtactggcacccttcgtatacgtaaacgtgcccaaggtttgcccggcagaatctgttaccggcatcacaacatcatgatcaatactgacgtacgttggaatctcaacggttgccgtatcgccagcttttatcacttcagaatctgggatactccaatgatacgttaattggtagccagccttatcattcaacgtacttgtgtcagtaacgggcttgccattcgcatcaagtacgatggcattgccagccgttaaacccgtaacactgatttctttagcatgtgcagtactccccagcataaatagcgctaatattgccgtcaacatgcttagcatatacccaactagctttcttcgcatacgctcctcccccattcaaaaaaagctttgtctttgtcattctcacaacccaacacaccctcacagtcgcgtatgattgtcagggtcggccaccagttagtgattcacgctaatcagctccatatgtacaatactgcaaccaaccagtttactacgaatcaaaacttttatttgcgaactatccgaactaatcgtttagcaaaaaaggcctctagaactatgcctagaagtctaccggaaattccatttacattgtctcgctaaaaacagccacaaagctaagccttaagttgaaggcacctttattctggaatatgactcgaatcaacaacctaaccaactgaaagttacgccaatatgcttacgataatgccaatatcatcgtctgatgtcgcaaacccgcctccataaacgggcgcccttgtggctgataccctaattgtgtataaaacccttgtgcagtgacttgagcgcctagtaccaactgtcgccaaccacggctcagcccatccgctgcaatacgttgaagcaattgccgtgcatagccctgccctcgcgccgctttcaacgtggcaactcgttgaacatgtcccgtccattggtcgctaggtgtcactcgcgctgtggccaccgcctgcttttgatcatcatacaagacgtagtgccacgtcgctggagtgaccgtatcaatttccaaagtttcatcgatatgttgttcctgcacaaagactgcccgccggattgcaatggcatccgcataaactgatgaatcaacctggttactcatttttatctgcatcacgttatcacccgttcttctgaaatactttgagaatacgcgtttcaccggttatcgtcaaactaactcgaaacgaaattaacgcattcttaaaattgttagcgattacgagttccgatgttatgttaaaatgatttgatgactggttatcgagtcatatccaaatttgttaaaaatgaggtctttatcgatgtttaccaaatttcgccaatacgttaacacgcgaattggatttttttggctactagtcttcttattctgggccaaaacgatctatgcgtacttaaccgaattttcactaggcgttgccgatccactccaggcattcctgatgctcgtgaacccgattgcaacgacggtctttctgtttagtctggcgttctacattcgtaaaaccggtgtatattactatattttgctattcattgatgcactcgacaccattttactgtatgccaacgttatctaccatcgtgaattcacggatttcatgactgttagtacgattaccggcgtgtccaaggtcagtcagggacttaccggctcatcgttagccctagcgagttggggcgatgttctttactgggcggatattattgtcattctggccttggtcattcttcatcggattaagcaagacacacgaccaattaagaaacacacggcctttgcgtacacctctgccgcgattgcaggtttcggtcttaacttgaccttagcagaatccaaccgaccacaactactaaccagaacgtttgaccgcacttatatcgtcaaatatcttggtatagatgcttttacagtctatgatggtatcaaggatgaacagaccaatcatcaacgcgccagcgcaaagaaatcagaattagataccgttaaagattatactgaatcacactatgccgcgccaaacgctaagatgtacggtctggcgaagggtcgcaacgtcattgtgattcatctagaaagttttcaacaatttcttattgatcagaaagtcaacggtaaggaagttacgccgttcttaaataaactgtatcatagcaactcaacttacagttttaagaactttttccaccaagttggtcaagggaaaacttctgatgccgaaaatatgcttgaaactagtacttacgggctctcaactggatcattgttctcccaattaggctcagataatacgttccaggccgctcccgcgattctaaaccaacgggccaattattcctccgccgtcttccacggtaacgtggccagtttctggaatcgaaataacacgtataagaatatggggtaccaatatttctttgatgccagttatttcgatacgactggtgataaatcaactggatatggtctaaaggataagctgttatttaagaattcagttcagtatcttgaacggctacaacaaccgttctacgtcaaatacatcacggtaacgaaccacttcccattcacacttgataaggaagacacgacgtttaagacaacggatactagtgattccgccattaacggttacttccagaccgcccactacctcgatcaatccgtcaaagaattctatacctacttgcaaaaggctggtttattaaagaattcgatgatcgtactctatggtgaccactacggcttatccaacagtgaaaactcgaccttggcacctattctcggtaaatctgcggacgattggacttcctttgatagcgcccagcttcaacgtgtgccattcatgatcaatattccaggaatcaagagtggtaaagtcgaatcgacttatggcggtgaaattgacgtcctaccaacgattctgcacttactagggatttcaagcaaacgttatattcagtttgggaccgacctcttctctaaacaacacgatagtaccgttgcgtttagaaatcgcgatttcgtcacgtctaaatacaccgtccttagcggcaaaatttatgacaacgcaactggcgaaacgattgatgatgatgaggcagttcagaagactgttgataaagatcagaagaaagtcgacaaagaattaagcctctctgattcacttaacaataaaaatttgttacgtttctacacccctaagggcttcaagaaagtcgacgcttctaattacaattacgccgatggccttgaaaaagaaattcagattcaaaataaattagctggcaagtcaaccagtctctactcgaagaatggtaataagtcaacggactcgttgtatacgaccgacgcaccggaagcttcgcataagaagactgattctactcgtatcaagattaccaaccctgatgatacggatagtaccacgactagctctagcagttccaaatagcaacaagcattccatttacaatgcaaggcgcgacggcaatttatttgccatcgcgcctttttatgatctcctttaaatatgacgctgccctcatccatctggcatcggttgcatgataaaatactaattgtggtttgtctcatgcttgcgcattacgatgattaacacgtgccatctcttaagttcagtgccgttcatcagccattcgcgcggattaccgaaacgtgctcggtagccccattatgcttagttgaaagtggtttcctagagtgactaatctaagcaattatttagataaaaataactaacacaatgcgtgttacaataaaattaataatgacttgattcgtcaatgccggatcaagggaggaggcaccacgcatgggcgcttggcgtttttggtgggatagtacccgccgtttttataagaactggggcagttacgttgccctgatatttagtaccaatttggtcattagttacctagcaattcctttttttaattgggtgctagaaatgttactcaagtggcaacgggtcagttatgtctcgtacacgaatatcggtagtattattattcaccaaccactggccgcactcggtatggtggcgatcttattagccattattattttagtttattggcaatttgcgtttctgctactgggtattatgaatatctttcgtggccgaccacaaactgtacgcgcggtcttgcggtcaacggtcactagtctgactggcacctcacccagcactttcttattctttatcggctactttattgtgattttgccatttggaagtttcatctttacaacaccattactcaacaaggccaaaattccagccttcattgtcagctatctcatggaaaacccgtggatgacgctcggcttggggtgcttctacttgctggctggttaccttggaattcgcctaattagcctattaccgctaatgattgtcgatcggcttccatggaaaacggccgttactcgtagttggcaacaaacgcgccaccatctttggcgctacttatggaccatgattgtgaccttatttatgatttttctgatcgtcacgaccatttatacgttgatttacgtagcccagcttcaattcgataaaacaagttttgccatggccgctgccactgttaatctctttatcatggaagcaatcaccgaaattattatttgttataccacggccatcttcatgatgttaattattgtttgctatcgtcaagactttacactcctccgccaacaaccgcaatactttaacgaggcaccacggttgcgcaaattgacccgggcgagtgttgcaattggcttgctgttagcgacaagtttgctagttgccgttaatttagtctacttaaatggactagtgattaccaagccaatcatgatttcccaccgcggcgtcgataacggtaacggcgtgcaaaacacaattcctgcactgatcaagaccagcaaggaacatccggattacgttgagatggacatccaagtcaccaaggaccatcaattcgttgtcatgcatgatccaaccttaaaagccttagctggcgttaagaaaaagccatctcaattaacattaaaacaactagaaaaaattactgttcgtgaaaatggctatcaggcaaagattccaagtttcgatgcttacctgaaagcggctcacaagcatcatcaaaaactattagtcgaaatcaagaccagctcggcttacaccgccgccgatactaaacggttcatcgatcgttatggtgcgaccctactggctcatcatgaccaagtccatacgcttagtttcaaagtcatgcgtgatttgaaacgcttagatcaaaaacaattcgttagttacatcttgccttataatctcacgttcccgcatacagtcgcgaacggctacaccatggaggtcaccacattaaacgaccaattcgttgacaaggctgaccgcaatcacaagacggtttacgcctgggacattgataatacggaccaaatggatcaaatgatgttcatgggcgtcaccggcgtagtcactgataatctaacggaaatgcagcaagaagttaagagcaacaccgaccatcccagctatgccaaactcttattgacttttatgaatgaattaagtctaactagcaacgagtaatccacattatttcaaagttgctgtcacagcgagtgcataaatcattcagcaaccacgaaaattctgaatgatgtcgttgctgaaaaagtgacttccagctgatgacgaatcgtaagcgccatctgaatgcataagtgcatttggatagcgctttttttgatctgattagccgtcgcggtgattgagatgttggtaaaaaactgtattaaagtgcgcagcgctccgggttatctgccattttaatttctaaagcgcacgaatgccgatagttgatcagccactgatttttaatacttttaccgccaattaggtgctcatatggaatgacccagaaacagggtctgaaccatgaagtcctttgatgacagtacgttatcagggacgtcaatattagataaaaaccagaaagagccatgagttatcatgactccgtaagcaacagattggtagcagttcgtcctacttttgcttgtgtctcaacacaacaaccgaaatacccaaaattccaagaactattggaacatcgattgcggtaaccggcaatccaaattgcgataaaatgtaaatgaagcatactattaataaaacaccaccgtatttttaaaaaaaaccgataattacattgtctggataacgcttttttaaatacagtaatagaaaaataaaacacaaataaagtatcgtatgcttcacaacacttagtgacatataaaatctaatcatctaaactaacacaccatcaataatggaaccttttgccataaacagaatcatcctctcaaattctacgttaacaacaggcagtatgttacgaatttatcttaacaacagcgtttctttatcgttatcaattttcagtaaattttgtgtatttttttgtacaaacttatacattgtaaaagtttagccggagcgaccggttgtttttttattttaagacacaccaaagctatctagattaaaaaaaacatttgcctttctaccacttcatggtacaacaggccgccaataaagcgggttcttaaaggaacaagcaaataggacgagaagccaagattcggtttctcgtcctatttgcttgtatagagccagttatatcgcagctcttttaaacttacattttttcaaacacggtcgtactatgcagtggactccgtcgttcgggatacaaggtcatcattaactgattgaccgcgttaggagcttccccgaagccactggcaatcaagcctaacttgcccgcgtaagtcaccgtatcaccaatagccgcaatcccaggtacgtcggtattcatctccgtatcaacggtgatgagtcggtgcgccatggttggggtcacgtgccagtttcggatgactttattatccgcgataaagccgtagttaacaatcaaatcatcaacggccaatgtttcttcagttgtgccgcgaacctctttcatcgtcagctgtaactgtccggtagccgtctctgcaagttgcttaatcaaaaatggcgtcttgatttcaacggaagacgcttttaacaagtccacattgtgttccatcccacggaagcgatcacgccgatgcatgatataaacgtgcttagcaacgggttctagcatcaaggccatatcgatggctgagtcgccaccacccgcaactagtaccgttcgatccgtaaattgcttgacacttggaatgtggtaaaacaattgcttattctcaaattcagccgcattatcgactgctaagcgccggggttcaaaagccccactcccagtcgctacgataatcgctttggaatgtgactgctgtccactcgccgtggtaatggtgaaatcacccatcgctcccgtgacatccgtcaccgggctcgccaattgaatgtcaattggaaattgtgtgagttgcttttcaagttgtgccaccagttcacggcccttgattgccggatatcccgcaacgtcatgaatgatcttctcaggatacaaagcctgaacctgaccccctaattcggggagactttctaataactgaacccgcgcattacgcataccagcatagaaggctgcaaacatgccgaccgggccaccaccaataattgttaaatcatattctgaactcatcgtttcccagctctcttctatgtagacttattgcttctcattctagtggattcggcgaaggtttgcaaaagcaatttttactaattcgactataataggattcaaaggcgaggtggatcagtgatgcgacgaattaaaattattaaaatcatggccattattagtgcgaccctggtcgtggggattggatcctattggcaacatcgcttgaccacattacgaaaaacgcgggtcgcccaaacgagtattccgaccatcttcgtcggtggcgattacgcacgcgcattttctaccgacggctttgtgcaccgcttaaccgcggcaaacctgatgacgaaaggattggtcgtccatgttagtcacgccggccacgtgaccgtccaacagttcggaccactaaaaaacaacccaacgattcaggttatctttgccgataatcatcatgcgaaacgtcaagctcggcagtttgctactgtcatgcaagtgcttgcaaaacgctaccacgtgacccgctacaatgctgtcggtcactcatctggaggtaatatcatctttgattatctgacagcgcaagtcccccagcgcgcacaaatcaataagtttgtgaccattggctcgacctatccgggcttgaccactcagcagttaaaccggttaccacggtccttgccgatattgaatattgccggccatgtttggcatacaagtggtgatggcggcgtcaatttacaagccgtacttaaattcagccatcaattattggcagctggttggtcaccaaaaacccaaatcattcacggtagtcccctgaccgccagccactcaatgttgcatatcaatccacaggtcgacttactcatcatccagttcttgtacggcaactgatcaattcatcgaggcgtgctgccaatcaacctgaagcacgccacacttctaatttaacaggattcggacacccttacgtcccttggatgggatggcaaatggtgtcttttctggtatcctaaaacatcacatatcagttaataacgcaatcacaaaaagtctgctaaatctggccgcataccgttagttaagctagcaaacggtgttttgtcagcgatttccatgtacaacggtggtaatgtatgggtatatcttaatggaggcgattaccatgcgcaaaaaatggcgatggttattattagcactcactggaattttctttttgatgttcgggccacccttagttagtcaggcccgcaacgtaattgaagcaacgggcaacgatgttaatagtgcggttatcaaagatagtaagggcaagataatggctcacgatgcacaattgccagaagaccaagaatacacagtcaattacaactggcgcatccctgataacctcaagatcaaggcgggcgacacgatggctttccaagtccccgaaaacgttcgtattccgcatgacgaggcttttccaatgaaaggaaccactgcaggtaccatcggaaccttcttcattgctgccggcgcacatacgggtctcgtcacatttaatcaggcctatcaaaccagaccacgtaatcggaaagggtttgttcaattggacgccttcggaaccgttcctagtcatcctggcaacttagccccaattttattagagaaatcagctgaatgggctgacgaagctaatccacggcggatcaactggacaattcgtgtcttgcctaataacaatcagctcgtcgatcccacctttgttgatacgttgagtccgaaccaaacgtatgtcaatggcagcgccgtcctacgcgatgagacaggtaatattattcccgtcaatacgagcgtgaatggtaatcaattgacgtttaatgccacagggtcgtttacgtcagagttagctttgacctaccaaactaagactaacgaacccactggcgacgcaacttttgaaaataatgtcacctatactgacaagaacggcaacaagggatccgcgacagccacgatttcacggccagtcaccgaaccggacgttcccgaaaatccaggtatttcggaaccaacagatcccgatgaagatgaagaaccaggagttactgaaccggaaaaacctgggactaccgaacccgagaaacctgggactaccgaacccgagaaacccggagtcaccgaaccagaaaaacctgggactactgaaccggagaagcccggggtcaccgaaccggaaaaacctgggactaccgaacccgagaaacccggcgtcaccgaaccagaaaaacctgggactactgaaccggagaaacccggcgtcactgaaccagaaaaacctgggactactgagccggagaaacccggcgtcactgaaccagaaaaacctgggactactgaaccggagaaacccggcgttactgaaccagaaaaacctgggactactgaaccggagaaacccggcgtcactgaaccagaaaagcctggcactactgaaccggaaaaacccggcgtcactgaaccagaaaagcctggcactactgaaccagaaaagccgggtaccgtctcaccagaaaaaccgagtggtcctaagcccaccaatccaggaaccgtaacacctgaaaaaccaacggccgtcactccagccgttccaaatgagtcgtctccatcgacacccgcaccaagcgtcagtggtaatctgtcagcacctgccaatccagcgacaaattcgactaacacgaccgtcacaacggttccggcaactaatcccttaccagcatcggcagctacagcttttgcaggctcagcaccgatgaataagtcgttgccacaaactaacgaacactcggcaagttggtcagtaactatcggtctcgccttattgattggattactcggtagcgcttttgtcctgacacgccgaactaagcatcggcattcataattagcttgtcacaccgtcaaaaaaatgagctactcacatcgcgttgaactgacgatcaacggtgtgagtagctcattttttataatttcaacttgctgctagtaacactgcgcgatactttgttagtcggtctcacgatctagttgctccagcgccgtttttaattgtgcttgcgcactcgcatccagtgagggatacgctaatggcaattccgacaggcgttgattgatgatttccgaaacacagagccgcgaataccacttactatccgacggaatgacgtaccacggtgtcgctttagtagccgtcttggtgatagcatcatcataagcacgctgataatcatcccaatactgccgttcctgaatatcggcagctgagaatttccagttgtgacttggaatgtcaatacggcgaataaaacgttgcttctgttccgcctttgacatgtgtaagaagaacttgagcactaagtagccgttgtgttgcaagtaatcttcaaagtaccgaagatcgttaaaacgacgttcaaaaaaagcatcatccacttgtttcttatcgttaatctcaccgacgtgctcattcacaataatttccggatggactcgactaacaagtacgtcttcataatacgaccgattgaagatcccaatcatgccgcgtttggggacccgatcatgaattctccataaataatcatgcgcaatttctttagtagttggttgcttgaacgatgtgacttcacagccttgggggttgaccccactcatgatatggcgaatcatactgtccttacccgccgcatccatcgcctgaaaaatgactaaaacaccaaatcggtcttgtgcatataacttaccttgcagttcagtcagttgcttaatattcttggcgatttgcgccttgatgaccttttcgtcttcaaattcttgatcaaccgccgttgctaatttagttaatcctaatttttgctttccagtatatcggtagtgcttttcaaaattcacgttctagcttcccctcaatttatcgataatcgactaatgtcgctagcggttgatgatctgctggcttgccagcaacggccgctttgccaattgaaacgagcaatagtggccgataccgctgggcgtcaagttccaaaatagacgtgaatccggcagcatcaaacccggtcatcggattcgtatcaaagccatgatctttagccactaacataaattgcatcgcaatcaggccagcatctagggcgccaatggtctcgtcaccagtatcaaattgttgcccctgactggcctgaaacgctggcgcttggtgttgattttcacgatccagcacaaataagacgacggcactggccgtagttaactgactggtattaccagtcgcggcacacaaccgttgtcgcaaggctgcatcctcaatcaccaacgcccgaatcggttgttgattcaacgcggttggtgccaaaaatgcggtctgtaacatcgcggtcatttcttcacgcccaattttagtttggccgtcatattgccgaaccgaatggcgcgcgttcatgattgcttctaatggactattcgtcgtcatcagcttcaccttccttaattgtcagtatagaacagccttcaacatttcgccagtaagcgtggtcgtgaaatatttccgaacatttttctgttcaatgttaatttaattcgccgctagccgttgtcagcatcagctgaaacgtttacaattaaaacatagctttatagcgcttcggacctaatcagggaggatgttttacatggcaaaacgtaaaatgattttagacttagacaccgggattgacgacgcaatggccattgcctacgcagtcggtgcacccgacgttgatttaattgggattatcagttcttatgggaactgcctagtggatcaggcggcgattaacagtttacaaattctagaactactaggtgccactgacgtacccgtctttctaggtgaaccccactccagtacgacggaacactttgacgttatgccgatttcacagcagattcatggcatgaacggtatcggcgacgtgaaccttcctgaaccgaaacgcgccgtggaaaagcagtccggtgtcgacttcttaattgatgccgttcaccaatatggcgccgatctgactctagtgccaaccggtcccttaaccaacttggccgaagcactcgaaaaagcaccagacattgccagcaccattggtaatgtgaccttaatgggtggtgcactgactgttccaggtaatgtcagtcactacgctgaagccaatattaatcaagatgccgaagcggccaacgccgtcttcaccagtacgatgcctcttacgatggtcggactcgacgtaacgttacggacattattaaccaagactgaaacacaacaatggcgggacttaaagacaactgcgggcgaaaaatttgctgacattgttgactattacattgcggcttacgatattacgagtcctgacttacacggttgtgccttacacgatccactggcagtcggcgtttcactcgatccaagttttgtcactacgttagacctgaatatgtacgtccaggctagtggtgaagattatggccggacaattggtgaccctgcgcgactcaatgacccaactaacgtcacggttgcgttaacggtcgacaaggatcgttatttgaagacattcatgaattacctgacgacattatttaaagcccattagttatatttcatcatggcaaccggatcacagaagttcgcttccgtgatccggttgttattatttatttacaagtctgctaatttttcatttttccccggcaatttatgttaaattagcagtatcaccattcagaaagtaggtatcgtcatggcacaaaaatattacgctgttcgtaagggacgccaacctggtatttaccgcacctggcccgaaactcaaaagcaagttagcggttatccacaagcacagtacaagagcttcacaagcgagaaagacgctcaggattttatggctggtaaggacagtccaacccgaccagctcactcaaaatcaatatctaatcaagcgccggtcaacgcaaccattactgtttatactgatggcggttcgcgaaataccggaaacgttgccggtcagcacgtgcaccaagatgataaggctgcctgggcttatcggattgaaatgcccgaccaacttgtcactgactctgccggcgaatggggtgccaccaataatcgtatggaaatcatggccttcttacgagctcttgaacaattgcaacagcttggccaaactaagactgggattctgttcgtacttgattcacagtatgtcctcaacgcagtcaccaagggctggctggctggttggaaacgacgcggctggaaacgcagcaatgggccgttagttaacgccgagttatggcgtgaagtcgaccggttgcttccagcattcactgcactcaattaccgctggactaagggccacgctaccaatcagggcaatgtctttgtcgatcatttgttgaatcagactatggatcagatgcacgctggtcagccggcccaagcctcgactggtgctaagattagtccacagccaactaaaactagtgtgccacagccgactatgtcgaacccaacaccaactaagtctaatcagtcggccactgtacgctcgacaccagctgaaaaaaagccagttgatcccgaacaagtcgcccgttcagtagcagcgatcaagaagatgctacgcgataactaatgtgctgcacgcgaactcaagatgataccgaagtacactcaaaaagttaaccaatctagtactcagtctcgcaattagattagagcacgtctctgctgtcaatcagaaattcaatgaaacgtgctcgtttaaatgacgcattatcctaataatgagctgtatcaggtaaacaactaggcaacatgtatgttctatcactgtccacgactcaataactagtaacacataactcaaaagctagtttcgccatcttttattgcgaaactagcttttttactattgttggcttgaattcgatggctcaactcgaaggtggtgcttcatcaattaaattaatgctgtcgtaacgcagcccataaatatgaacaataaaccagtcgcgacgctcacaatactttgttgacccgtacgctcatgtaaaaagaacagcccactaagtgttgaaatcaccacactaagttgaccaataatataggcattggtcaccccaattgaccgagctgataagatgtacatgaaagcagcaataccatataaaatacccggaagcgtgttttgccagctttgcttatcccgatagacagttggctgatgatatattgcccacccgaccgcaactatcaatattcccaacatctgaggtaaaaaaagttgtaatgcgtcaactttaaccagcttaggaatacaactataaatccaataaccaatggtggtcatcaaaagtggcaaataacaactaaattctttcttccgaccatctgaggttcccgctgacaatgctgaaccggcaacaatcaacataatggctaatagtcctaatattttttggttactgcttccccactcgccaaacatcaagacaccgatcaacgaagttccaaccaattgaagcgccgttgaaatcggcattgtcttagatacaccaagtaagcgataactgatatactggcctaattgtccgatggcccacgcagcacccgaaatcattgccaacccaaatgtgactcccgatatcgttacagtaggttgggagaacaaccagaaaataagggctataagtccaacaccgatacccataccaaacatttcattttcagaatgaccattaattttacggactaataaggggttgatgccccaacacagtgctggaataatcgcaatcaaaaaaatcatttttcatctccccgcattgactaacaaattatcaagatcaatcggaacattatgcttggcatctaatttattgaataatcgatacaaggcaccataaagatttgcatcattgtgaaaacgactactcaaaatttcgggtcgagcaatggtacttttcacccatggtcgtcgttctaaaatccaatcgtattgccgattgatttcatcaatcagaatgggttgaaatgaaataccaccaccaataacgtatcgatccaagtctaagactgtctgaacattaagaattaacgctgcgacttcacgagcatactgtcgaaaaatttgtgtcgcttgtgcttgaccagcattgattgccgcaaaagcacagtgcccatctgttaaacaagacgcgccaattaccgtattaacagcttcaatcattcgtaccgctgaaccagtctttccaaacaacccatcatcagccagattggtctggtcagcaggcatcaagctgacttccccagctaaccgtcgactaccagcccacaaatgcccatccaacatgattccaccgccaacacatgttccaaatacaattgccatcccatttttgacatcattcagatttcctaaccatgattccgcaagcgccgcggatttaccatcattttcaactgatattggcagtcccaatttttgcaactttcgtggtaaacagacttcattcaaatatggcagggtagaattgcgacaatagatcgtatccgttgtcgtgtctacacgtccaggtgtactaaaagccaccccgtttaattggcccttcaacttgtcactaatcttttcaattgcttccaaaaactgtgttaatccctcgtgtggcgtttccattcgactctttttaatcatttgaccactgcgattaattaaggcatattttaaatttgtcccgccaacatctactgctaagtatcgtggttcttctgacattcaatcgtcacccttttctttatttacaccataccttactggtatcaaacaaatatgtaaacgttttccgaagcggttgaacacactgttaaatctgattattaattgttattacgaccaaaaacgcactagatcaactcattatgctttcatacctatcaccactaattgacttataaaatgacccttttagcacttttgtgcgttatataaaaaaagaaaactttagtgcagtcatatttgtttaagaatctcaacgaaaaaacgacttcaatttagaagtcgttgtcaaaattacatcgcacccaaaaatcaccgtggaaaatcagtggcacttaccacccattcacccgtactttaacaccatgtgcacgaatatgttcagcataatcaattaagtcatccgcttgtaactgtttaacattaactagcgcatattttcggcccaaatcttgatactttttcaacccaaactggtgaaatggcaataattcaacttcggttacgccaatctgattaaatagttgtccaaaatgatccgcgtcattcaatgtataattaaaacctggaataaccggaatccgaaccatcatcttttgatgagcttgcactgcagttgctaagttacgtaaaattaccccgttatcggcacccgttccgattcgatgttgggctgggtcccattgtttacagtcataatacatgaagtccatataagacatgaattcattaaaaaccttaggccgtgcgtaaccagttgtctcacaggctaaattaatgccagctgctttaactgccttagcaagctcaatcgcaaaagaagcttgaaaaagaacttcaccaccagagaaggttaccccaccgccagactcttcatagaagtctttatcttgtagaataactttcataatatcatcaaccgtcatataatcaccgacgatggtttgcttggcggtctgttcatcatacattgattcttgctcacctgattgtgattctggattagaacaccacttgcagcgtaacgggcaccctttaaagaaaactactgttcgaatacctggtccatcattgatactaaatttttgaatgttaaatattagtccttttacgggcgtcttagttgtgatcgttggcattatgaccactcctttacttaatgttgccttcagaataacaccaatcgcattaaacgtaaatgcttttagtttcaaacgaaagtaattttcaatcaaataaaatgttataatcattaaagcaaggaagtgaaaatctatgaatcaacgcaatgaacaattattagaaatcgtcaatcaacgaaaaaaagtcgaagtgaatgagttagcaagcttacttgaggtctcaaaagtgactatccgtaaggaccttactgaattagaaaatcgtggtctattgcaacggcaacatggttttgcaattattaataatccaaacaatctgaactttcgacttgctcaaaattacgacattaaacataaaattgcggaagccgccgcaactctagttcaagataatgagaccatcatgatcgaatcaggatcaacttgtgcacttttagccgaagaactaggaaaaagtgggaaacacgtgacaattattacaatttcatttttcatcgctaattacgtacgtaactacgacaatattacagcctacactttaggcggacaataccaatccgatgcccaagtggcagttggaccactaacaaaaacaatgctagctaactttcacaccgaaaagctttttttaggtattgacggtttcgatcgtaactacggcttttatggtaatgatattatgcgcactgatacggtccatgccatggctgataacgccgacaagacttatatcttaacagattcaagtaaatttgaactaaccagtactgttcaccaattgccgttccagcaagttgatacagtgattaccgacaaccaactttcaaaagaggctcatcgcgtactcaattttcaacaaatcaaagtccagactgttgcgactcattaagcaaattgtcgcaatgaccgaagcgactcaaaccgcatacttattgctgctacccccatcgacttcgatgagggtttttcgatacgcacttccttaattcattgatttttgcacaaatgtgcatttcataattattcattattttgatgatatttctaatcaaaagatgctatgattattacgtaagaaagtcattttggtttctaacgatagaaaggaagaatgatcatgtctgaaactttaactaaaacaacgacaactattaaccacttcggtaaattgacgccaatgatggatcgcttacgcgatagcatcattgatgcaaaaccttatgtcgatccagaacgggcgattctcacaaccgaaacttatcgacaacaccaagacgaacaagtcgatatattacgggctaaaatgcttgaacacgttcttgataaaatgagtatcttcattgaagatgatactttaattgttggtaaccaagcacgccaaaatcgttgggcaccagtattccctgagtattctatgaattgggtcattgatgaattagatacatttgagaagcgtcctggtgacgttttctatattacggagaaatctaaggaagaacttcgtgcgattgcgcctttctggaagcataataccttggaagaccgcggctacgctagttttccagaagcaagtcgtattttttatgatttaggtattattggagccgatggtaatatcacttctggtgatggtcacattgcggtcgactataagaacgttgttaataggtgacttaaatggtatgaagaccgcattaagacagcactttctaatcttgaccttactgattttaaccagcaaaaacaatactatttctataaagcgggcctaattgtaatcgatgccattcacaattttgctaaacgttacgctcaattagcgtccaagcaagctcaaagcacgacatccgcaactcgcaaagcacaacttgaaaaaatcgcccaaattctaaacaaggttccttacgaacctgcaaattcattttatgaagcgattcaagctgtctggttagttcatctgaccttacaaatcgaatccaacggtcattctgtctcatatggtcgtctagatcagtacctagatccattctatgagcacgatttaaaaactggtgctattaacgccaacggtgcaaccgaattactcacaaacttatgtcttaagacgttaacgattaataaagtacgcccatggcaacatactgaattttctgcagggagtcccctctaccaaaacattacgattggtggtcaaacaccagatggtaaagatgccgttaatccgacgtcctatctgattttacgagcaattgcgcaagcacatttaccacaacccaacttaacggtccgttatcaccatggcttaagcgataagtttatgcgtgaatgtgtcgaagttattaaacaaggcttaggtatgcctgcgtttaataacgacgaaattattattccgtcgtttattcgtcgtggcgtcaagaaagaagacgcctataattacagtgccatcggttgtgtcgaaacagcaatccctggaaaatggggctatcgttgcaccgggatgagcttcattaacttcccacgcgttctcttgctcattatgaatggtggcattgatcctgaatctggcaaacggttattacccgattatggtaagttcactgatatgacttcttttgatcaacttatgactgcttgggacaaagcgctccgtgaaatgacacgacaaagtgtgattatcgaaaatagttgtgatttggctttggaacaaaattatcctgatattctctgctccgttttaaccgacgattgtatcggtcgtggtaagaccattaaagaaggtggcgcggtatacgactttatcagtggattacaagttggtattgctaacctagcggactccctagctgcaatcaagaaacttgtctttgaagaaaagaagttgacaacaacccaactttggcacgcacttaccactgattttgcggatgaagacggtgaaaatattcgtcagatgctcattaatgatgccccaaagtatggtaacgatgatgattatgttgatgatttgattgttgaagcttataaaccatatattgatgaaattgccaagtacaaaaacacgcgctacggtcgcggccctattggtggcttgcgttacgcagtaacctcttctatttcggccaacgttggtcaagggcacagcactttggctacaccagatggtcggcacgctcggacaccattagccgaaggttgctcaccagaacatgcaatggatactgatggcccaactgctgtgttcaaatcagtttccaagttatccactaaggacatcactggtggcgtattactgaaccaaaagatgtcaccacaaattctacggagtgatgaaagctgcatgaaattggttgcactactacggaccttcttcaaccgacttcatggttaccatgtccaatacaacattgtttcacgggataccttgattgatgcacagaaccatcctgacaagcaccgtgacttgattgttcgggttgctggatattccgccttcttcgtgggcctatccaaagaaacccaagatgatattatcgaacggacggagcagtctctataatctatatagtttgctagtccaagtaatttgaaaagtattgtcttaaggcccctaccaatccactctcagctggtttcgcttggagcaacaattaagaagtcaaaaaccgacttttctagaactcagcttctggaaaaatcggtttttatgacgttatcttattatttagtagtgatttaatttgttttgtcacgccacatcattgtatgtcatactaacagtatggccttgtagcagtcatctgtgcaaccaataatcaattaggcaatcaatcaaaaccgattaacactcactgtagtcggttacctgccattcaagtggcccatagaatatgttcgtcattaccgttcattagccaatttattcgcagttgcagtgattggaccgcgtgcactcaaatcgacgtcaaccgcgtttcaacgtttgttaagaatcctgtgtaaacggcgtctaacatactaacgaaacgaatttacgcctaatcagaccttttccagatcgactaagctggccgtgctggaacttaagcaacaacccgatttaatcatagtccatgacaggtttaactagcagaatgcgtattaagtataattattggatttgttcgtcactcttagaaagaagtcttccaaatgagtcataatcgccgacaattactggccaaggtcgcttatctatattatgagcgtgaccatactcaagcccagattgcgaaagagctaaacatttatcgcactaccattagccgcatgttaaaacaagctcgtcaattaggcattgtcgagattaaaatcaatgattttaattctgatttatttgccttagaagaacaactcaagcaacgctaccacttgaagaaagctgttgtcatcgctggcgagccacacgctaatcatcagcgtaaagaacatctactatcaacagaagctgcgctctacctcaaacaaatcatcaaaccaaataacattgtcggttttgcttgggggtcaattctcagtggtatgattggacaattgcagcaccctattcaaactgatgctacttttgtaccactagtcggtggtcctagcccatcgaatgcagcataccacgttaatggtatcgtctacgatgcagcacgtacctttggtggtcacagtttatttgtagatgctgctgcagttcaagaatccaaatacattcgcgatggtatcttgacatccaattacttccgccaaattcgtgattgttggaaccacctagatattgcactactcggtattggggggccactctccaataccagtagccgttggcgcgatctgttaaccgatactgaccgtgaacttttaaaggaacgacaagcaattggtgattgttgttgtaccttttttgataagcatggcaaaattctgactggtgacctgcttgatcgcacaattgcgattccactaccacaattagcacacgtccctaattcaatcggaattgctcgttcactaaccaaagcccccgccatcttagcgctcttaaaaatgggggtcctaaacacactagttacggatgccgagactgcacaaagagtgctggatttggacgattagcacatttgtgcattttccaatcataaaaagatgctcatccctgttataacgggattctagcgattattactctgcagatcattggtatcgcttccataaccggttatcatatagttgtaaataaaaacaggggtgactatcatggaattcttattagatactgtacacattgaagatattaaaaaatacgtggatatcataccacttagcggcgtaacgtctaatccttcgatcgttaagaaggaaggtcgcattgactttttcaagcatatgcgggctgttcgacaaatcattggtgaccaagcaacactccacattcaagccgttggtcaaaccacagatgcaatgttacaagatgcatatacgattcttaaaaatgttgatgaaaatgtttatattaagattccgacaaatgaagctggattagcagccatcaaacaattgaaagctgctggtattaatgttaccgcaaccgcaatttatacgaagtttcaaggttatctagctatgacggcaggtgccgattatctcgcaccttattacaaccggatggttaatatgaatattaatgccgatgaagttatcggcgagctttcgacccagattttacgtgaaaacagtaacactaaaatcttagcagccagcttccacaccgtacagcaggtcaactcagcctttgaaatgggtgcccaagctgcaacgatgagtgctgacattctaaaaacggctctttcggcaccggctatcagtgctgccattaatgattttacaactgactgggaatcactttacggtcagggaagcaccatcagctcacttgctaaaaaacagaacttgactaccatgacaaattaaattaaaaataacgtcacaatgatgattagtacaccattgtgacgttatttatctcacgacagattagtagcacggaaaatatgaaaacaatgtgccaattagtgggtcgcagttagtcaatcaggacacgtcccccgctagttttctacattgattaacaattaagtatgagctcattcatagttattcaactgctcaatttaatcataattcacactcaactaatatgcccctgttgctaccatctttaaatccaaccgattgattttagaccattttcaatcccatcgtgatcacaatcagtcgtcgtcatatcagcttgagccttaatttcaggtgcagcatttcccattgcgataccaataccggcactctgcaacatttcacgatcattttgattatctccaaatgcaacaacattttcaggagcaactttcaacgatgcggccagcttggcgacaccctgcgcctttgaacccactttgggaataatatcgacaccgttaacatcaaagcgaacaaatgagaattcatctgcatgcggtaaattagcgtcctgctggtgcggataaaacatcattgcttgataaatatcattatccaaataataatttggtgcatattcaacagccggtgcccgaaaagtgtgtagtactcgtcgggtttgttcattcagatgcgtgtgcgcatgcaacccatctaacgactcaaaaataatatcaatattattcgcatccgcagcggcaactaatgtcgccatgttatcacgcgagagcgtatgttcatgaacctgttgatggttggcaaatgcggcggagccattgcaaagtacaaaatcattcaggtcaagcttatgaatgactgccttagccatcgccagattacgcccagtggcaattgcaacattaatttgttgttgctttaacttcttaatactcgtcaacgtactttttaaaaacgtcttgttacttgctaataatgtatcgtcaatatcaaaaactgctaactttgctaccataactgttcctccgacctatctttcaataaattctgattttattaattggtgtttctgaccatgactaatcgacaactcaaaggcagcttttcctaatgcttccaagtgatggtcaattgttgaaaactgcataagtcgactggaaagtagattttcttgtccaataatttttaccggtgttaactggtgtacccgataatagtcctgaataccagcaccaatatcgtcgccattcgctaaaatggcatcaacggatggcttcaactttgcaaagtagcgccccgcacgataaccgtcttcgaaagtgaccgcaccagtaaacagattagctgctggtaattttccatacgtttcttgataggccattcgggtcacccgagaactggcactgatcaaattatcccgactaataaccacccctacattttgacagccttgttgcttggcccacatcaaggcacttatatatgatgctaaacggtcggtataagctgcagccaagtgactactcgttcctggatcttcacaacagacaattcgaccatacttctgatagcgctccaacgcctccaacgagttactacgcgatgtaaatattaacgcatcataagccttgctcttaagctgttcaaggtaatgtcgttccactgtcatatcataattagtcggcaacaatgtgactttgtaaccctttgcaaaaccggcactaacaatcccatcaacaattcgggcaaaatagggatggttcgcatatggtaagacgatcccaatcgtcttagtttgtcccttactcaaatctcgtgctaaccgattaggaacatagtccaattctttaatcagggcttcaatctttttccgcttatcatctgcaacgtacttttgatgattaatcacacgcgagacggtcgaaactgagtatcccgataatcgagcaatgtcatggatattggtcattaattccaccttcgtcttatttttttgattcttaattgattgccggccaatatttaacacttcgctagtgtagcctgtgaaaccggtaccaggtcaatcaaacatcccggtgattgttaagaatttcgcacaatcccatcatttatcgtacaatgttaatattggagggattgtatgcaacttattgaacaattaagccatcgttctgactttaccactaccgaaacacgcattgcaacttatattttgagtcaccaagatgcaatgcctaatatcttaattaaagaattggctgctaaaacttatacctcgcattctgccataattcggttagcgcaaaagctagggtttcatgggtttcgtgattttcagcgagcactaacaactgaaattgtcattaacacccaggccacaacaaacgttgatgctaactttccattcactgataaagacgcagtcactgaaatcatcaaaaaaatggcagatctaaaaaccaatgccattgccaatgctcaacatcaattgagacctgaagtgctaacaaagtctgcttatttgctaaacaatgcacgacatattatgctcttttcccaaggtgactctcagctacgggctcgcagttttcaaaataagctcgttaaaattaaccgatttgcccaaattgccgaaatgtatgcagatgaggcctggaatattgccagcctgacaccacaagattgtgccatgttcatttcatacgctggtaacactaatgttcatcagcgatttgccaaatactgtcaagcacatcatattcctgtcatcgtcttaactggaaatgtcgattcaccgctacaacaattcgccacctatcaattagtcatcacacaaaacgaacggaataacgccaaactaggaacgtttgcctcacaagtctcatttgactacgtcttggacacactctttgcaatcatgtatgcaaataacttccaaacaaacttagcccacttgaaaacaactcaactgttgattcaagatgggacactacagacaaaatagcgtgacgaattgtcattctacaattgaatagccgcttttaaaaaggccaccttcttaattttatgagaagtcggccttttcaatcacattaatacgaatctataataatttgataattagctgtggaaattagcccaattgcaatcccgcgctcgctaacgcttggtcaacaacttccatgactgcttgggaatgatctaattgccgcttaacggttaccatatcgtgattagcaataagacgttcaaatgccacaaactcagcatacatccgatgctcagcttgattaagcgctaaatcagttgtcgttccatcatgtgcaatttcagtgatactttcgaccgtattagtaggaccgttgacaatgatcgaaccagtcgtcccctgaatcgtggaacgtaccggtgaagtcgaatccttggcaccgatacaaacgactttaacattcggataggtcaacactaagatgcctgatgtatcaatatttcgttcaacattagctaaatactgcacgtgcgttggtgcgcctaacaagccaaccacaaaatgaatattataaatattcaagtccatcagggcgcccccaccaagcttaggattaaaagctggtaagatcgttccggctttaaactgatcataacgtgatgaatactgcgaatagttgcattcgataattttcaagtcgcccaacttggtcaaatcacgtttgattgcctgatagttttccaaatactgattcgtaattgcttcgattaacactaagtcttggcgacctgccaattcgattagttccgttaactgagatgccactaacgtaaacggcttctcacaaatgacgttcttccccgcttgcaatgcccgcttcgcatagccataatgtaacgaattcggcaaagcgacgtacactgtatcaattgtcgtatcggctagcaaagctgcataatctgtgtagaccgttccaatacgatacgtggcttgcagctcgcgtgctcgcgccacactccgcggcgttgacagcaatcccaccaattcaatcgcgggaatgctcttcaccattggcaagaagtcctgaacaatcttgcctgttcctaaaatccctaatcgcatcataatcctcctcataatttatattaacgaattaataccggccaaatgcaaccagctaaggcccactgaaaaaagctcaagtttacgtaaacatgcttagccagcgtcggcttacgccgacctccaacaattggcaccaatctcctaggacgcacaccggtagccgaacaacaatctaaagctgacacgtactaatagctgggctagtgcaacactcaagaagcgctaatgtcggcattgttgaataccagtttctaacattttcacttgtaacaacgtttcctcatctttgactaacttgggttgtccattgatgatgctgtcgtaaacgccggcgtaaacccgactgtagtcaccaacttccgaaacgactgcctcttcgtgatactgaccggcatcgtcgatataagttaacgtgccatagttttcaggttgatcaatgccaaagtcagcgtgattcggcatgtaaaaatgtttcagatcgtattcctgacgatccttagtcgcctttacgaacatgccctttttgccataaaccacgaagctcggccgtgatttaatgcggaaatagctagattttacagagactttcaaggcaccgtaatacagatcgatatcaaaataatcattcatccggtcacttcccaatagttgccgaacatcatagtgcacgtcatccggctccccgaagtatgcaatcacttggtctaaagtatggcaagcatgaccatataaataactcgtatctaatgaaaaatggtcaacattggttggaacctctggccggaaataatcgaagtgcatttcgacttccagcaagtcaccgaggacgccgctttcaatgaccttttgtgtcgtcaaatagtccgaatcaaagcgccgattctggtaacactgaataaacaaatgcttttgcttagccaattcaaaaagttcgcgggcttccgctgatgtttccgtaaatggtttttccaccaagacattcttaccatggttcaagacatccttagctaccgaatagtgcgtatgactaggtgttgaaacaactacgagctgaatatcagggtcctcataaatatctgctaacgtagtcgtgtaatgcacgcccgcaattggttgccaattctggtgtcctgaacgtgaatagatggtcttcaccttaatttgatctttgagtttcagtgcaaatggtaagtgatagcggttagcactcttaccgttgccgatataagcaattgttaacatcgcgatgtcctccagttaagttgataatttcattatactgacttagaacgtcacgccaagctaatgacatactttaggtcaaaacgttcaataattaacttctaatcggtctgtttttaaacattaggtccagccccaaattaatcattgcagataatacttttattcatatgattgcgttaaaattaaactactttacaaaatctaggaggaaatttggtttgcaaaccgttttcttagtcttattactcgtcgcggctgtcgtcgttgctaacgccgtctacgcacgtttcaatcaaattccagtcgcctttttacaaattggggctgggttaatcttgtctctgattccgttgtatcgaaattttgaattggaacctgaaattttcctattcgtcattatttcgattttaatgtttaacgatggccaaaacaccaatattcgcaagctcagtcaccagtttggcacgaccctttcgctttcggtagtgttagccatcgtgaccattctaattgttggtacggtcactcacttactaattcccgagttttcgctggcacttgcttttgcccttggcgctattattacgccaaccgatgccgtcgcggtctcatcgattacgactaaagttgcgattccaggtgaggtcatgacgacccttgaaaatgaatcactgttcaatgacgcttccggaatcgtggcctttaacttagcgattgctgcgatcgtcactggtaagttttcggtctggcacggagtcactaactttttatatgtttttgccggtggaatcttcgtcggcctaatcatcggttatgtcattgttgctgtcaggatcatgctgattcgcatgcgggtcgatacaccttctgtgatcgtcccctacacattactgacaccgtttgtcgtctatttcttagctgaatcattaggcgtttccggtatcttggctgttgttgccaccggtctcattcatggtgtccagtccgatcaattgcggttgaccacttcccggctacaaatcgtgatgacaacgacttggtcaatcgtggctagtattttgaacggtatcgtctttgtgttattaggtgtgtcgttgccaagtgtcatcaaccacttacagcaacgtgatactagtttggtcgcggtattagtcggtctgggaatcttgctctacctaatcatgacgttcgcccgttttctctggacgcgcttcgacttagcccgtattcgcgcgtgggataatcatgaaaagacccgtaatgcattcgtgatgggtctgagcggcgttcacggcacgattacactggcgatggccttttcattaccactaacactcaatggcagtgcttttccttatcgcaacgatattattttcgttgccgcagtggtcattctaactagtctgctggtgccaacacttttgttaccgttgacgttgccaaaacaagttgttaaggtcactgaagatgaattggcaaccgccaaagctgacatggtaactcacgctattgatctcatgcaagcacgccatggtaataatgctggcactagtaaagtgattgcgattctgtccggccaacgagtactagatggtcgtcctaagcgctcgcaactggcgagcttgttcgacgccactttcaaagttgaacaaaccactattgatgaaatggttgccaacaatgaaatcacgccccatgccgccgaaaagtacatgcgcgtcgctagtcagacgcgtctgcagaatcaacaaactttcttcgaacgcttgaaattatttttccggtttacactcagcaaatggtcgctcagcaaaaaagctcgtgcccgacgtaaaatgttccgacaataccggccccgtggtggtcagagtcgaactgagctcatgactcgtaatcggcaaatgtggcaacaaatgcgacagatcgaacaaaagccgtatgaggccgtgttagcttatttagccgacacgattactgctgacaatcagcaagctatcgggatcgttcgccgtgcctatgatgaacgtcatcgccgcctatctggtgaacgggatttccaggaaactcaaaatgagcttctaattgaagcattccagttggaatataacttcattcagacccaattagccaataaaacattcagctcagaacttggtaaccaactctatgaacaaatttcaactgatcagttagtttacttgcaatcgatcaataccgactaaattcgtttagtaatgtcaataacgtgaccaactgtccacaccactatttgggcatcgggtccgttacactaacgttgtaccattggtcgaactgccaactgaacgtctcaacaagccccccaatcttgtgaccatggtaacctaatgacgcctgacaacttgtcggcgtcattttttatgatatttttgaaacaaaacacttgtcttagagtggctctaaggtgctaatctataaaagtattcatgaatgagaaagtgagcgatagataatggaaacaccgattttagcacgcattgatcagccggccgatctgaaacaattatccttgccggaattaacacaactcgcaagcgagttacgtcacgtcctactcaataaagttagtcaaactggtggtcacgttggccctaacttgggcgtagtcgatcgaattaaccattgcctttcacaccatttttaattcaccagttgataaggttgtatgggatgtttcacaccaatcctacacacacaagattctaacgggccgaaagcaagcttggcttgaccccgctcattataatgatgtcagcggctacactgccccagaagaaagcctccacgactatttcaatattggtcatacttcaacctcgattgccttggcaactggcatggctgttgctcgtgaccttgagggcaaaacaggcaatgtcatggcagtgattggtgacggctcattatccggtggtttagcattggaaggtctaaacatcgcggccaccttaaagtctaacctcattattctggttaacgataatggcatggcaattgcagaagaccatggtggcatttaccaaaatctccgtgaactccgcgaaactaacggcacgagttcccataacttgttcaaagattttggcctcgattatcgctacgttgatgatggtaacgaccttgagaccatgctaacgacttttaaggaaattaaggatgttgaccacccaatcgtgttgcacgtccataccgaaaagggccacggctatcaacccgcgatcactaataaagaagctttccactggcacgtgccgtttgacctagcgaccggtcagacgttgcatcccaacaccaaggaaacgtatacggatgtcattcatgccacgttagccgatgagttagcagccaagacgcctatcacggcaattacggcggctgttccaggaacttatgacctcaaacgctttgctcgccaatatccagaccggtactttgacgtcggcattgccgaacaagaatcgattacatttgctgccggacaggcccaacaaggcttacggccaatcgtcttccattctggtaccttcttgcaacgggcctatgatcaactatcccatgatcttggcatcaataaattgcccgttacgatcatggttgccggtggccgcattaacgcaggcgatccaactcatcaaggtatctttgacgttgccatgctcagtaatattcctaacttaacttacttagcgccaacgaccaaggaagaacttcaagccatgatgcactgggctctccatcaaaataacggtccggttgccatccgggtaccaagtaatgacgtccagtcagtacctctagcgcctgattttgacgcaactaagatgcacacattacacgctggtcagcaagttgctttactcggtgtaggcagtctcctgcctttagcaacagccgtgcaacaacaattagctgagcaacacattgacgcgacgctcattgatccccgggacatttctgaccccgatacgacgactttggccaacttaaaggccgaccatcagttagttgtcacggttgaggaagccagtctcagcggtggttttggtgaaaaagttagtcgctactatggcaacagcgctatgcgcgttctgaactttggtgctgccaaacgctttaatgaccgtgaaacaactaatgaactgcggcatgaatttaagctgacccctgaccaaattgtcacggcaattactgatcaactagcagaataatcatcaggccagcgactcaactttcgtttacccatcaaaagtctgaccagcatgttgtcgacatcaacagcacgctggctagactttttatatttaactgacaataacccaatctcagtttaacgattgggaaaacaggacggcggctactgtgccaatttggggcaaaaatcagcaattagcaaacagaacgccggctaataagtcgccattcgcaattatttatattaacgcccgatacctggcgccttggtcggccacaaaatattattaatattttattgttcagaaaaaactttcagcaagctgctgtccttatagctccaaatctcattaatataattatttagtcaatccaacgctagttaaacaattgacagtcccatcagagttgtttacagtaaaaccaatctcaaacctaatattggaggcctttattatggcaagtcaccaagccttactgattattgattatacgaatgattttgtggctgacggcggggcactcacttgtgggcaacccggccaagcgctcgcaccaacgatcgtcaaactcgccaaccaaatggctacggcaagcgactgggtcttactgccaaccgatgtccataccccgcatgatccttaccatcccgaaagcaagttgtttccacctcataatgttcggggtacctggggtcgtgaactctatgggccactcaaagattggtacgctgatcatcaagccgccgataatgtttgggcattcgacaagacgcgttacagttcatttgcgggtactgatttggatttacgtctgcgagaacgccatgttgacaccctgcatttagtcggtgtttgtaccgacatttgtgtccttcacacggctgttgacgcctataatttgggttaccaactcgtcattcatcagggtgccgttgctagttttgacgccgctggtcacgaatgggcgttgcgtcacttcaaaaacagcttaggtgcaaccatcgtttaaaaaatgcgcaataaaaatcactcatccaatacgaatgagtgattttttaggattactaaattaattcaaggttggctcaacccatttttgcaacatcaaggtattcaacacaccttcaactaagataactgccaacatgacgagactaccgacccataaagaatcgatttgtccctggttgactagctgactggagagaaagctgaccatgctaatcaacaaattagctaagcggaaagccacgtaaatgaccaccaccgtgataattacattgacgaaccgttgccgaaatcgtggtaaaaagcccttggtcgcattcgtaacaaaatggcaaagcgttatcgtgctccaaatcagaatcgtcacaagaactaagactagcaacgttccgagtgcgaactgcacggcactacccgcatcaaactggctaaagaacagcgacgctgatgttaagcctctcatcagttcattccaaccaatccacagagttaagcagaataaaatcacttgggccaaccaaacataaacaatattaaccaacgaaacgactaaattaatcgtatagcgtcgccaatcgctaattggcaataaccagaacgtccccgcccggaagaatttttcatttgaaactgccaataagataaacccaacgattaaaggtaacgccatccaagcacataaattatagaataatgtggcagctgtgaagtttcctttgatggcagtccacaaactagtaacaatcaccgccaaagcttcgataccaatcaataaactcatttgcttaaagcgtggccaactgagggccttaaatagtgaccaactacttgtcatccgtcacacctcccatatataagctctcataataatcttcaagttccatgccatgttcgtcgcgaatctcatctgcaccctgatgaacaacaattgtttggtccttaacgaccacgatttcatcaagaatcggcgcgatttcagtgacataatgatcactaatcaataatgtcgcttcggcaggcgtccacttgataatactgttaataatttttttgcggctcatactgtcgatcccactaaacggttcatctaataagtacaaagccactttgcgactcagggtcagcgcaatgattaatttctcacgggtccccttagacaactcgcccaatttttgttgttggttgagttccagaaagtcaaccagctcttgatagcgcttggcgtcaaaatcaggataaacaagttgataaaattgcgcgatttgttgtaatttcataccggcactaaaaccagtcaaatggtccgtgaaacttacctgctgcttacgggctacggcagttgtcgcgccattgatcacaatactgccctgacccttggcactacccgtaattagtcgcatcaaggtcgttttacccgccccgttttcacctaataaaccgacaatcttgctgggcgccagggttaattgaacattttgtaaaatcattcgttgattatgtttatatcgtaaatccttaatcgtcaatgctgtcatgattgtgctcctctcgttgggcaatgtattgttgcagactcgccacgatttcggcgtcacttaaatttagtgcgtgcaattggtcgtacgctaatgctaattgctcgttcaccagtgtggttctcaattgcataatatgcgcctgatcttccgttacgaaattccccttacctcgttgggacgtcagagtaccttccgtaatcatctcactgagtgcccgctgaactgtattaacattaaccgtcaagtccaacgcaagctgccggactgcgggcaactttgcccctggtggtaacgttccgtcaatcattttatgataaatatactgtttgatttgataataaatcggaaccttgtcatcaaatttcaatttaacggcctccttagtgttctatttttctattacaatataacacagctggtaccaaaagtacaataatgacctaccgttacttgtgatagcggttacatttgtagcttgaatctcaattcaggagcgctatacttaaattaggacgtggactaagttcgccacatcacaggagagggatggtagcatgttaaaaaacgaaaacgctattgcgctaattcgcgccatcgatgtcgcttatagtgaccccgaagtacgcgcaattcccgaattacaacaagccttagctaaggccgcacaagacttagactgtgttgcggaccaccatcaagtcgctagccgcctaaaccagttgctaactacttggggggctcgtcattcacaaggccccgccgtacttgaccagttatacctgatcacactcaaagatggcgtcgatgtaccttgccaggtcccataccgggcataattatcttaatatcacaaaagctcccagatcgaatcaatttgggagcttttgtgatattaagaggccgtttgtttgattcctgtttgtcagcaatgatcatcctattccgacctccggggctgggtgacaattgctggaacgtaagccgaaagcaccccacttccgactaagaataatttggctactgagcattgtcacccagcgcctccagtcggtaagccgctcgaatggctgatgaacggccactgaactcggtacaatttgtcgttggctattttggcaaaggaacctccaacgaaaatttaaggttaacagtaaccgctttgtctagacggtcaattattactatgttgattgaggaatagggagctatcacaacatcaccttcagcctgacagttgattgagaaaattaccgtttatgaaaagcaacgataaatccagcaaaagttgggtatatccctgtccgccattcgaatactctcccgactggaaggcgtttctgacaatgcccagtggtgaaatttcacttagcaagcgtcctgtgcttggttagtgaaaggctagtatttgagacgtggtttttcggctcaaatctgtacccaccacgttccggcaattggcaaaaatgcctggaagtcggcgtaggacgaactaactaagcaaggttacgctaactcgcactttttccagtggtccatagctggctgcttttgaccttgaaagttagcctcttaatatcacgattcatgacaaatcagtgctaattcaagcaagctaacattattgtacgtattgttccaagaatgcggcgacgtgaagcttgtaacgttggtaattctgagtaatggccgtggtgtggccggctcccttcaccaaccataaagacttgggttggtgagcattgcggtacagcgtcttgcccatgctagtcgggacaaaatcatcccgggtgccgctgataatcatgataggcaagtggtttttacgaatctgagcgactgcatccgcctctttgaagctataaccagcacgtaatttagtaatgagactggttacgttgactaacggaaacgcgggtaaatgatagagttgccccgcttgataactaataatcgcatcagcactcgtaaacggactatcgacaacgtacgctttgatctgtggcaactgccgttcaccactggccatcgtcatcccggctgcacccatactgataccgctcatcacgatttgagttgtggccgttctatgtacgacggttttagcccactgcaagtcgtcgcggcgctccagccagccgtaaccgaccgcttttccctggctcgcaccacttgctcgggaatcaggaaccagcacgttgtagccgagttcatgatacatccccgcccacgcacccatcaaacccttattcccagcaaatccgtgtgccaaaacaacagtcttcttagaattcttaactggaatataccaagcaaccaaccgtaaatgatccgatgactcaatagtccaagtctgcttacgcgcatgtaaataccaatacttttggtgataaaccgaactttttttcgatagctttgtactctgcgtaacaaatgacttatcaccacgggcaattgccacgtggtaaaaataactgccagcaccaatcacagctcccgctaccagaacaacgagtacccccagtgtgatccaccatttcttcattaaaattcactccttgatgagacaaaaatctgttttgagcgggaaaatttcgccactacttcataataaccgttataattaaagataactagaccagattgaggaggcttctttttatgcactattccgaaacgtgggatttggacagtatctttgctggtggcattgattccccagcactaactgccaaaatgtccacgattaaacagcagttgaccacaacagcagacaccttagttcactggcgtgctgccgctgacacaccagacgccgactggtttacccaactcgtcaacagtctgcaagccattcaagccggtattgaccaagctaccgttttcgtggttgcttatcaatccgcacatgcggacgacaccaaagccgccccactactaaaccaaatttatcaacttgataatcagttaaacaatttattaacccgcttcaagaagcagctcgttaagttagatcaagccacctttgacacgctcgtgcaacaaccggcactacaagccatcgcctttaacttaaccgaaatgcgtcagcaaggcttagcgctcctagatgacgacactgaagccctaatcaatgacttagcactcgacggttttcagggttggagtgaccactacgacacgttagttagccaaattcaagtgccctataccgatgaaaacggaataacccagcaactatccgcgggtcaagctcaaaacatgttagcagccgccatgccgaacgcccaacgcgccgaattaatgcgcaactgggagcacgcttggcaaactcacgccgctccctttgctgatacgttgaaccacttggcgggcttccgacttgccaattatcgtgcgcatggtacgacgaacttcctacagaaaccactagaactcaaccgcatgagtcaagcgacactagacacaatgtaccaagttgtcgctgacagcaaggacattttactaagttacctgaagcgtaaggcccagttactcggtaaagatcaactagattggcaagatattgaagccccactaaccttgggacaacttcctagccaaacttacgatcaagctgccgattttgtcattaacaactttcgccaatttagtccaaagatgggcgctttagcccaacacgcccttgaacatcgttgggttgaagctgagaatcgccctaataagcggcctggtggctatatggaaaatctaccagagacccacgaatcccgaattttcatgacgtttacgggttcacctaatgacacagccaccctcgcccacgaattagggcacgcctttcatggcagcgtcattcaagatctaccactttggcgtcaagattacgcgatgaacgtggccgaaaccgcctcaacattcgccgaactgattgtcgctgacgccagtgtcaaagcggccgatgatgccaaaaccaaattaactttattggatgctaaaatgcaaaatccgttagctatgtttctggatattcgagcccgcttcctgtttgagacgcgcttctataccgcccgtcagcacgggatcgtcactcctgacactttgtcagacttgatgctaaccgcccaaaaagacgcctatggtgatgccttaaatacttaccacccgatgttttgggctagcaagttgcacttttacattgacgacgtcccgttttataactttccatacacatttggctaccttttcagtctcggtatctatgctcaagctaaaacacaatcggactttgaagaccgctacattgccctattgcgagacaccgccaacatgtcgaccgaagccctagctgccaaacacctcggtgttgatctgaccaaaccggccttctggcaagctggtgtggctttgatcaagcgggacatcgatgaattcatggcgttatccgcaccgttaatctaaggaatggaagtgagcacatgtttccagaacgtttaagagcactacgtcgggggcaaaaaatgaccctcgctcaactcgcggcggccctcaatcaaatgccgaccgcagacaagacgactcgtcaaaataccgcggctcaaatcggtaactgggagcgggacttacggaccccgtcctacctagaagttcgtaaattagccgaatttttcaacgtcacgaccgattacttgtcaggtaaatcagaccaagaagagtatgacctcggtcgcatctttttatcgggcaagccgttgacgtttaatcaagaacaattatccagtgaagaccgctatgaactgtttcagttgatggatggttacttacatggtcgccagcatcgagtttcaacggatgcgaccggccaagaagaattagacttacactttgatgactaggagttttttatgaatcccaagaagttaaaacaattaaaaaagcgggtcaaaaagcaagccggtgccccgtatattcaacagttaatgaagtaccgcgacttatttaaggatgatccccaaattctagtactgatcaataatgtcttggaaagtgaccgcttgctggcagccggcttagctccccaacaattgccagtcttagaagtccctgatgattttcaggaccatctctttgagcgcatcaatcagcaatatgccatgggtgatcctgctggtgatgcggcttggaatcaactatcagccgctctcccaaaagttgaccaacttctacgcaactttcgagactatatcgaagatcagtatgggatgtgggcctacatcagtgcgccatttctgaaagacctagctgacttcaccggcagcgcaccagttctggaagtcatggccggtaacggctatatttccaagggcctcaaacgtctccatcctggtcagccaatttataccacggattcaaaggattggacacacgaaactggcaatcagacaggacgccacccagtcacgacgattgaagtgttggatgccgtcagtgccttcaataagtacgccgcaactattaaatacgtcattatggcctggtcaccggacaaattgactattgattgggacttgttacaagctatgcggcaaagtccttacgatatcccattgatcgtcattggcgaaaaatacggcgccacgggttccaaacaattttgggaccacgctaattatcaggataacgaggccgttaccaagttaaatgctcatttccgaccattcgacctgattcacgaccacgtctatgtggtccgataattgaacacgcgttaaattaaagtcgtgctttcaggattaaattctgagagcacgacttttaatttttccgtcatagctgaatctcttttttgccaaattcattcgtgatttgcttaaatcttagcatcacattttcaattgttgcagttgttccaatcccgccaccaacgatgttcgtgaaattcccccggcagcgagactttggtcgtcaaattgattaagcgtcgcataaagccaaattccgagctgcaagaattcagcttccgtcattgcgaactgcaacgctaacaaccgctgagcggcttgagcataggcccttctgtcaattagttgtgccaattcgacttgatgtggcaacggctgatcttgcggaaacaccacctcagttgtgcctcccttatgacgactaagcgtgtaccctaaccccgttgcgaacgcatgtaactgccgcattaatcaatcactttcatcttgcattagcattaatccccctaattgtgtgccatccaataaatcgctaaaattgtcaaaatgactgataacgtacacatgtaccagtaaaattgtttttccggtactgttcgaccatgctttccctgataggcatccgccatactagtgataaacgtcgccaaaattgtatataagatcaataacgtaaacgcgtaggccgtccaagccgtccccatcggttggtgcattgcttgcaagccccagccaatcaaccatcccgccaataaaagacccgtaggcgctgcaattaaccgtcgcttcatcctcatcactccccctagaattagcttcattatccgcttttaaaactctcagaccaagcagaatgacgccctaaaattatatccgcatgataccaagccttttctgcacgaaatattgttaaaaggttccggtttaagatcaaaagcaaccagcttaggcccgctggaaaaagttcgaatcagcgtaaacatgcttggttaaacgcgtcctacgccgacttccaggcatttccgtcaattgctggaacgcggtggacacagatttaagccgcaacccacgtcttaaatactggtcttccactaaccaagcaaaggacgcttgctaagtgaaatttcaccgctgagcattgaccgaaacgccttccagtcgggacagtgttcgaatggctgacacgtgcgttccgaacttttgctggacttgtcattgttttttacaaacagtaatttgtcaattaactgtcaggttgatgatgctattgtgataacttaccatttctgaattaccgtagtaatagttgaatatttcgacaaagtagagaatacacattgatatttcactaaaagttccaataaaaaatagtcagcgactaattgtaccaagttaagtggctgttcatcagccattcgagcggcttcccaaaacgtgttcggtgccactaaagcctgtgcttgctacgccaacagacaaatgccaaaaccgcattaatcagttggctaggcaatgctcgacttcaacccgtggcccctcacaagctagagactggaggggctgggtgacaatgctcagtagccaaattattcttagtcggaagtgggttgcttccggcttagaataagactcgtatttgagatgacgcggattgtgcgttagctcaaatcgacgtcggctgcgttccagcaattgtcacccagccccggagttcggcataggacgcgcactggctgacgaacaggaatcgagttaaccggaaccttttaacaatgattcctgacctatcctagaacaaaaaagcctgcaatcaattgattgcaggctcgttcacactgactattcgacgttgaactccttgaaataactggttagtggtttcaattcgttcgcgtcatatttttctttgaaggcactgacagaagcatccgatgtcttggctggatcaacatcaaggatttcaactggtaacccccgtttgtccgtaatcttggcatcaattaagaccggacgacctgcctttaattcggtcatcgcagtttcgaaggctgcgtgcagttgatcaaaatgttcaacacggatacctttgacgcccattccttcagctatcttagcaaaatcagcatcaatcaagtcgataccataatatggttgcggcacatcttcttgttctgatttaataaagttcaacgtttggttagacgtgacaatattaaagattggcaagtgatacttaacttcggtcaacaagtcttgcatgaccattgagaaggccccgtcgccagcaatgttgaaggcttgccgatcaggataactcatcttcgccgcaatcgcaccgggaacgccggcacccatcgtggcaaatagtgctgaggtcaataatttttgcttgggattcatctttaggaaacggaaactattaatcgtattgtcgccaacatccattgagaaaactgcatcatcggtagcgacccggttgatttcttggtagacttgttcgtattcaagtggatcggtcgtccgttcactcaacttcttcaaatactgtttccagtcggccatatctgctttagctgcttggtagtatggcgacggtgacgctggttcacttaatgccaaggcccgtttgatgaagactttagcatcgccattaaccccgaaatccaaatgatggtgccgaccaaacttgccaggatccagttcaatttgcacatatttgaagtcgtgagtcgtgtacataatctgtgcgaacgaataatccgcgccaactgaaacgaccaaatcggtaatccccatcagttcatccgccgctttcgaggctgcccgataagcgcttcccatattaccatcaaagctatcaggaatgacgcccttggctaacccagtgataataatcggtacttgcagacgctccgctaacgccatcatgtcctcggttgcaccacgcgtcccttgaccaacgtggaagacggggtacttggcgttcttgatcatcgttaacaccgtcttaacttgttcatcatcaatagtaggaatgccggtcagtttagcagggacacttgctgaatcgtaattaagatcaggaatttcaacatacccaaaatcattaggaattgtcaccaccgcaaccccattttcacgataagccgtccgaatggccttatcgacgacgtatggtaagctttctggtgtcatgacggttcgattaaagaccgccacatcactaaaaatcggttcttcagcgaattcttggaaataatcatagttcatattagtatgagcaacttggcccaccaaggcaagtacgggcacgtgatcttccttagcatcatacaacccgttgagtaaattaacggcaccaggaccggccgacccaaaggcgaccccgattttacccgtcaactttgcatccgctgccgcagcgagggcccccacttgttcgtgacgtacctgcacatattggagccgttcttgctcaacatccaacgcgtgcatggttgagttaaacgatccaccagcatagccgtaaatctgtttaacatcccaagcttcaataacttttaacattgcaacagacgcttcaatcatctttgccatagtaaatgccttctttttaaaattattgtatacgttttcatttacggttatcagaatacatctaaattgttcaaaattcaattgtaaacaatcattattttataaatattttcttaactaaccaaattcgatgacctgacactggcccgaaatcgtgttagcctgccgttgttctggaaaatatcgaacgcttatccatcggcttaatctaaccaatcagcaaggtgaaataataatgaaagataaagcaattaatattctgactgccgaactgtcagcactccccgttttaataatgacgtactatgcgcttaccgcgaaaccgaccggacagtggcagctgacctttagtctccccgtttattggctgatcagttccgacctgctagcctatccctggctcctcacccggattccccgcttgcgccacaaccctctcaaaatgaattcactggctctaaaggcaagctcaagatacaactgccggctcaacgaacgggtcgcgcgctgggatgatgagatgaatctcgcgattttcttactggaacgcggttgtctaatgttactgtcagaaccactacttttaggcgatttaggctatcatagtgtccgacgattatggtattgatggcaataaaaagcacccatgctgttcagttttatgaacagtgtgggtgctgtgtgcattatttaagaatgttggtctccaagaaagcgacagcagcttcttgaatcttgtgaggtacgtggtgaacgccaccttcagcgcgtttaaagacagttgccttcagggctggctcatctttaaaacggtgcttaaaatcacgaatatactgataaggtaccatttgatcggccgtactgttgaaaaagaacattggtcgtcctgccagtgcttctgggtgttcagataagtcaaacttcgccagttgttgataagtttgttcaattagttctgctgggagcttagcttgtaatgccgctggtaattgtgcaacttgatcggttgcaaaggccaccggttctggtgaaccaattaacgagacaccagcaactaccgtgggctgcgttgccataataccggcagcggtaatgccgcccatcgaagttcccatgacaccgattttattagcatcactaattccagcagccactaaggccgcgactaattgtggaaattccgcaactgaatgtccaacaatcgaccaaaaatgttcaggatgccgatcgagatcagtcccatcatttcgactgccatgtaaatacgctgtcgggagaatgactcgaaaacccgcgcatactaactgataagccgtacccagttcagtcgctgtctgatttgtccaaccatgataatcgatgatcgttggtaatttagtttgtgcttgactagctgcaaacacgtgtaatacgggcaagtcaccaaatttggtcgtccgcaccaccacatcttcaaataaatttgttgtcatgtttatcaccgtttccaaaattaatagttaatagtgtagcagaagcccaaacgaaaaccaacccaaacgcgtccatcgtggttaaagcttaaccatcatggacgcactcgagttggctcgttttaacacggttagttatcagctaacgtcatgcctttcaaaactacttttcaagtgtatctaagaaatcttcaacttgcttttgggtcttacggaatttgtcaacatatcgaccaatttcttgaccatcttcaatcccaacgaaactaggaatccccatcacacccatgtcttgggcaatttcaatgttggcgtcacgatcaaccgtgatccagtcatattgatcgtacttcgcttcgatttggggcattactggtttaataaaagcgcaatccgggcaccagtccgccgtaaagaataacatgtgtttacccgtcttgatacgttcgcgaatttcttcgtcgcttaaagttgcagttgccatgaaaaatgcctccaatatctttataataattatagtttaccacatactaaaagtaagtaaagtcttttgctttattttgttgctcggatcagcgcttgcttgagatccgctgctaaatcggcactattttcgatcccaacggatagccgcaataagttagcggtgatcccctttgattgtcgttgctcttccgttaaatctgcgtgtgtctgaactgccggaactgttaacaggctctcgacaccgccaagactttccgcaaacgagattacgttcaatgctcgtaaaaaggtatcgacgtcggtacccgtagcgagataaaaactaatcattccaccacgtcctggatataagacacgttcaacgtgttcatctgcctcaaggaccgtaacgagttcctgcgcattagcctcctgctgatgcaaacgtaatggcaaagtcttcaagctccgtaagagcagccaagcgtcgaacgggtcaaggaccgcaccagtcgtcaccagattaaattcaagcgcatcagcatccgcctgcgacttgactaccactgcaccggctaaaacatcattatgaccggctaaatacttagttgcggaatgaacgacgatgtctgcgcctagatccagtggcttttgaatcaacggtgtatagaaagtattatcaacgattaacttgaggtcatgggcgtgtgcggtagccgctgtggccgtaatatctatgaccttcatggttggattcgatggcgtttccaaccacagggcaacggtttgatcgtctgccagtgctgccaatgtcgcttgatcctgcccatcccagacagcaaaatccaaatgataatggtcgtgtaagaggtcaaagaagcggtacgaacccccgtataagtcatcagacacaataattttgtcaccactattgaaaagcgtgaaaacgagctggattgccgccatgccagaagtcagcgcatacgcagcgatgccgtgttccatctctgccagcactcgttccaaaatacagcgggtcggttgggcctcgcgcgggtagtcaaatcccgtagattgtcctaaaccagcatgtcgatatgctgtcgacaagtagatgggcgccgaaattgccccggtcttctcatcatcactccgattaccagcttgtgctaaccgcgtttcaatgtgtaatttctcagcttgttttgtcataatctcaatcccatccaatctagttatggtcgggcagtctacagagacgccagtgtaaaaatgactacaaaaaaagccgccatcttcaagggacgccggtcgcgtgttaccacccaagttcaattacgggtcaccccgttaaactcatcaagtcattattgactcactggagtatcggccagtcccgccagtacagccttgcgaccgcaactgggcattccgagttcatcttcatcaggcgctaccttaccgctttacactccccacggctccctgtcaaaggtataacctgactactcttctcatcaacatgttatttaatgatattttcatcttgctctcataataataggagcgcaagccccaatcttatttcagcacaataaaaaatggtgccagcattatcctgaccaccatttttacagaaacgcattcgacactgcctagctatcccaataatttcaagacaatcacaaaatatcctaaaatcaaaatactcaaccccagcgtcttcaagagggctaaccactggccccctgcagttcgacctttagggcccagacaaatcgcaacgccgccacaaatcacggccaaggttcctagctcacggccccagtttgcattcaataagtaaatgaacggtcccactaagccgctgacaatcgcgacgatccccagtattttcagaatcaagcggcccagtcgcttatcctgttcgtcataaatttcatgtttctcttttgccatcaaaccagccaccaatctttatgaactactttcagtatgccgtatttggtcacaatgagcaagaaggcggttacaatatcctggtcaaattactgaggcatcactaggctagcttgtcataccttgggccctgccggcacttacccgtgataacagctgaatcaagctaccaaattgaccatgatgatactaaaaattaggtgttcaaaattgacacccgctgaacacccaattggcaataactatttttcaattgtaacctgctaaacgacgccattatggctgtgttgcaacaacttgccatacgttccccttagccaactgctgttgttccaattgaccttgggcgttaatccgaaaacgacccgctaagtgtgcgacatcggcgttggtattttcataaacttccacgtaaactaaaccaccgctttgatactgattaaacacaaagttttgcttattggcggttgtttgttgatagtccttagccacttgttgccaagcccaatcattaatctgactagctgttaactgctgtggattggtcgtctgctggccgctagttgatgatgaggtcgcggatgcagactgcccggtagttgtttgactagttgcagtggtatttgaatgtccctgcgagctagctgcagtagctgtcttactaccctgactagtcgttgcactagcttcggattgtgactcattagctgaagttgtggaaactgacgatgctttagttgacgacgatttagcagctgtcgattgcttcgtcgactttgctgaagatgacgcgtcttttttagccttagtctttgacacaactgattgtgtttcactaacccgcgactgactagactgatggtcggcttctaagtaataaccgcctcccagcgcaatgatcccagcaatcacggctgaactaactaacatttttttcaagataatcaactccccaaagattaattgtctgatgctaactacagcatacgctatgttgtctcactttaccaacgtttacctgttctggatcgaaatttaactttaaattatatttggctcagttggtccatttttgggcacctaagattcattgtgccatccttttcttgactacgtatctcctcaacaacaaccgtggcatcagcagaaatgaattttgttaacttgaaagctgtttccacaaccttatttctttaaagttcattttgccatcatactgccccttataagtatatcgtaaatgacacccgactacggcccaaagcgggctaacaatgtaaccgtttcataatttgtcatcaaattgttacttatgtgaggcccccttcgcatgctatagtaatcaaccgatacaaaaaaactaggagtgtgtgaatagaatgccacgtaatttaaaagaagaagttgtctttaccgccattatggccggtttaatggtctttgtgatgaccgcctataacgttacccttgctcaaggtttcagcaacgggttagtaatggcaatccttagtggctacccactcggtttattcgttgccatcattttagacttattggtcgtgggaccaattgccaaacgattagctttcaaatatatcattaatgattacatgcgcaaacgggttgtcttgattgggattaccatctccgtcttgatggttcttggcatggtaacttgcatgtccctcttcgggattgcagtggaaggtgaattgtccggaagtcacgttttagcgacttacggtcacacttggatctttaacttgattgttgcattaccactccaactcatcatcgtcggcccaatcgcccgcggtgtgcttggaaaaatgcaacgggcaactgctaacaccgagtcagcagctgcaatgaacgaagaggactaatctttcagtccattgacggacggtcgccgggataatcttatcctgatggccgtccgttttattttacgactatccagtcgaccaccgcttttgccgaatagtccaccctatgaaagtcttatgcgtgatctgtacgcaaaaaaaacgcgtgtcagccatccgaaaatggttaacacgcgttcatcgcggcactggtaaaaccagcgggagtgacactccacaatgtcagtgacccagacactctgaaatacgtcagagaaacgtgccccgctatcaatatcagtcactagccgctcgcgcggaaccgttattgctaacgatctgactctatcgactcatcgcatggactaccgtatcatcttcattgataaaatgcaagtcgcaccgccacaaaattcgtggctcctactcaccacagttgggccgcagtacttaacttttcgcaaccaaaaaaattgagtatcccgttcgatttaatgaacgacacactcaattccattggtattttgattttggcttggctccaatatcaattcttaccttaccatagtcatgtaaagatttagtaattaactcgtaaagattacgtttaagcttccgccgccgtgatctggtctaagcgatcagtctgagccgtcagccaatcggttaataacttttcagcgttggcttgatcagcgagcacgtcggcaacgcttcccagctcatcaattcgcaatcctgacggtaacgcatcggattctgcaatcatgtaaacgttgattggcagcgtatcctctgccgccgtaacctttccaatttcggtcagattagccagtggcaaattaataacactcgtctccaaccgaaagctgatagctggctcatgcttagccgtcagcgtcacttgggcaagctggtcggcattgagtgccgctaccagcttcgccagccaaggcttaaccttggtcgctagtttggcataggtaccagtcaagctatcctgcgtaaccttgtcagccgtaacatcatcaataaaagcttgtacgtttcgttgcataaaacattatccctcattcattattcaatttcgttaatttgcacgtcgccagcgagtcagtaacaccaacgtataaaagttgatccccaatccaatcacacccataacttctaacgccagtttaatttccatgccagccgtactctgatagcccgacattaaggcgctgacaagtcctaagctatatatcagtacaactaaccctaggacgtaaaaacccagcatacgattaatatacactgctagaacgcctagaaaatataagactagggcaatcagcaacccctgccacatttccgctaccgaaatattttttgcctgcaggtgaaaatggctagtcgacatcatccaattgacgataccgtaacaaaaaaaggacacaaacgcaaatgcaactaagcgagtcagtttcaacaaatcactcctattattgggcaattaagtcaataacggctgaccgttcaattcccgtgaagtactgatttaaatcaatatctgccagcgctttagcgatggcctcatggtcgtaccgcacacctttaagggcggcttcaatatcttgaacgttgccactaccaaagaaatcaccataaaatttaatgttattgatcaagccgtcatcaaccgagatccgcgcatcaatggttcccatatcaaagtgttgacgccgcttaaccgagaattccggtgatttaccgtaaacccaatcccaattagcataatagtcttcgtaaattttatcaatagctttttgttgttcaggtgtcacgtgatattccttatccgcaatctgatccaacgaatcaacatggaacaactcttttaacagggcatcctgaaattctggcaccgtgatattctgatattctggcgctaaataaggccgtaaattcgtgacccgactccgaacggacttaatacctttggaagcaatcttgtcggtcgggactgttagcgcctgtgggacaacgtttaaatcaacattcaacatcaaagtgccatgggagaacgtcttgccattccgtgaatacatggcgttaccggagaatttcttaccatcaacgagcaaatcattgcgaccactgaccgtcgctgtcgtcgcccccatatcgtgaagcgcatcaatgattggcttggtaaatgtcttaaagtcgccaaactcttgactgtcactatccaccacaaagctgaagcagaggttaccaagatcttgatacacagccccaccaccagagagacgccgcgttacggtaatgtgatgttcccggacatagtcggcattaatttcttcaagggtgttctggttccgaccaacaatgatgcacggttcttcatagtagaacaaaactaatggttcatcgaaatccacgttattcattaaatattgttcggttgccaagttacggccaatctcatgatctttcattgcgacataatacatgttttaaaatctccttcagctttaggttactttaatcatacagcaagatgaaaaaaggacccacaatgtgagcccattttttggaagaatcatacaaaaagtttggcgtggcattcttcacaccacaagatgactgattcactatccacatccgtgaacgtttgattggcggcaatccgttctccgtggacataaccgtgccatcaatagatggaggttgggccagtcagttatccgaaattagcggaaacgctgctatactgcactagctatcacttgacgggtttgttacaacaattgggtaacagtttgatactgacctgtgactcttccgataaatccaatatagcatacaatgtaagcgattgcaaaccgagtaaaaaaacaacctagtcagccgaagccaactaggttgccgaaacattaatagcggtcgtaatcgctattccatttcaatatccttagtataaagccatttggacgccggaacaactaatatgcctagccttcaagcttagcaacatagtgcgttgcaccggagcgactcagatatcggagccacgtgtaaccctcagcttgaaccgtcccattgtaataaaccgtttcacctgggttatattcaccgacaacgcttgcgcgcgtacttggcgccgtacgaatattagtcgtcgttacgaagcggaacgccccttgactgtttgttaccggcttagacgccgtatttccggtagcggcattaccactaatcgctacgtaatgttgggcgcccgaataagacaaataccgtaaccaagtctggccgttagccgttaccttagcgttgtagtagactgtatcaccagcactataggtaccgacacttggggcatttccggccggtgtattcttaatcgccgttgtttgcgtaaagcgataactaccactttgaggcgttacttgcggtttatcaacattggtcgacgtactctcaccactaatttgcacataatgctggacacctgagtaagacatgtaacgtaaccaagtctgaccatttgtcgtcaccttaccattgtaatagaccgtatcgccagcattataagacccaaccgttgtcgcactagttgcaggtgaactcttgattgctgtcgttttcgtgaaacgatacgacccactggttgcaaccacgtccggtttagccacagaaccaacctcatcaccactcatagccacgtaatgctgagcgcctgaataggataaataccgtaaccaagttgtcccacccgtggtaatcttgccattatagtaaaccgtctcaccagcattataagtgccgaccacttgagccgttttgcttgcagctgatcgaatgttggtctttgcggtaaacttatacgacccactagctggcgtaactgtcgcctggttattattatcattagttgttgtttgactaatcatcacataccgtgatacgccagaataggactgatagcgtaaccaagttgcattaccgaccgttaacttaccattgtaattgactgtttcaccagcgttgtaagtacccactacggcactcgtggcgtccggcgcattgtgaattgtcgttgtcttagtaaacttatgtgtaccactggttggggtgacgtcttgatcaggctgaacttggttattatcatttccgccacttgcctgaccactgagcgcttcttgatcccactcgtgtagcttgttatattcaatgatgctgatcagcgaactcgcgtacgttggcgcggttgcgtagccgtcttgttgcaagagactggcaacgcgccgataatcggtaaccccaattaaattgctgtaacgcggattgacaaccaaaaaggcgccatgatcttcaacactagctgaccaattcgggtacttccgaaaagcgtcttgaatcgtaatgtattgtgagccattccattcctgggttgggaagtagattgattgcccttgataacttcccttgataccgaataagttgtttccctgagttgcaagttgtgattgtccccaaccactttccagaattgcctgtgcggccgtgactgatggcaagacttgatacttgttccaaccagagattgcccccgctttaatctgactcaggaagatttcctgactagtcattgcccgcgtggaccgtgccatcatcgctgatgactggaccgcatcagccgccacagccgtctcaatctttggtgagattttcgcggctaccgcctgctcagtcgcttgcttaggtgcggctgacgatgcggctgatttggctacttcactcgtcacagtcacgctggattggtccgtagtgacatgactatcctgacttgcggccgcgctggctttagccgtctcattagtcgtactgtgactggcttggctcgtggctgcactagctttggccgttttatcaagttgatcaacagcactagttgtggagtccgccgtagcactagcagccgcgttatccttggcagcttcactggcggaggactgactttgcagttctgtactgtcagctttagcgacttgactggctgcccgcactgtgacacgacttgtcgcactggtagtagccgtcgtcgtgctggtcgattcagcttgatcgtcagtcttggcaccgtcactggcaactgattggtcagtcgcaccggccgctgtcgtttccgtctgactgccagcacttaaggtcacttgttggcttgcagctgaagcagcgctgtttcccttagtcgcagctgccggtttttgatttgtacttgccgtatcagctttaccactcaacatcggcagcaaagcggtacttagcaataatgaagttactactttttttgtcattccaattttcaattttaaaatccccaaactttccgtgagttagctgttagcacaaccgatttaattcccctgtagcacctgctattacagaataatattagcatgtcgaagagggacattcaaacgagatcgcttcgaattattttattaatatcaattgattgacaccgttatcattttaactgattgatcagttaacaatttgttatcgttgaccgaattgacaatcgccgcaagacgttatgaccagggctttcccaaaatcaactcgcttctcaattactgtgtttaaattaaatgtgactgattgatcgattaacgaccttgaagaatattatttttcaatgactagtaccaactgaaaaaaactagtcatttttcagtccattaaaataattattcttacaaactcaagttatcaaataaatcaatcgattttaaatgcttacattgctgaaaattaatgctaaaatatagttattaactagccatatcaaacgggggtaaccattatgttacaacaatatcaaaatatcctggtaccagttgatggctccaaggctaccgacgaagttcttcggcggggcatcgaagtcgctaagcgtaacaagacccatctcgacattttaaacgtgttggaagtcaaccaatttagtgacacgtacggcggtgcggtcagtggtgatgtcatctacaagttgtcggaagacgttcaaaagcgcttggaagaactcaagcaacaaacgattgacgctggggtgacagacgttgatgtccatgttcgttttggtaatcccaaaacggttatcgcgcgtgaatttcccgctgaccaccataatgaattaattatgattggttcaaccggcttatctgccgttgaacgtttgatggtcggttccgtaaccacctacgtcagtcgcaacgcaatttgtgacgttttgatcgttaagccggccgctaaaagagaagactaacaaaaaagtctggatacgttccagacttttttagtggtttccgtgcgttgcccgtcttcttccccgttataaaggagctttattcatgacctggacttatcaactcactatcccgtctagtttgaatcaacagtcgattcgggcttgccttcggacttggctgattccaaagcggattcagggccagttacgccaaacgcggcggattcagctgaacggtgcaccaacgtcgattgcacaactcgtcaatactggtgattgcctgacgctgacgtttatccccagtgactttcggactccgacctcgaactatattgcggctgccacggccccagccacgattttatatcaaaacagcgatctgttagtcgttgataaacccgctggcgtgaaatcgcatcctaatcaaccaggtgaaaccggatcaattttaaatgacctagcagccacactccaaccaactcagcaggtgccatacatggttcaccggctcgaccagatgacttctggtgcgatgctagtcgcattgaacccggtcgtcgtcccgattttagaccgcttaatcagtgacaagcaaattcgccggacttattatgcctgggtacgtggtcactttgccacgccaactgggcatttcaccgcgccaatcggtcacgatgctaccgacaaacgcaaacgctgggtcaacacggccgatgcccagccagcactcaccgactacgaagtatgtgcaacaaccgcccatcagagtttagttaaactgaccctgcatactggccgtacccatcagctacgggtccacttggccgccagtgaccacccgattatcggtgatccactttacgactcgcaagcggagtcggcacctcggctgatgttacatgcccaattgttggatctacaacttccatttagcaccacacgggtgacggtaccggccccattgccaagtttatttaatagaccgcatttaattgagcgctactgactaagcaagttcaacttcattcagctggctaccgacgcttgccatcaaactgttatgaaagtatctatcttgaagggtccaaaaaggaagctcagtgagcttcctttttttgacacctgcatatttatcttagccacaaagagcttaattatgcctctaaactgttaatttgagcgataataaatcttatcacttggaatgttttggggatcattttgcgttcctaacgccgcaatacggtcccgactactatcaccattatttagatcagcattatttccaccgggcataaataccacatcataaagtccgccagatgagcctgatattgaaaaactgccttgaagcatgctggcaccgtttgaggtttgataagttaattgttgatgatacttcaatccatcaaccgtcttagaatttccttgctgatcatctaatgatggcacatccattttgagtttagtaatcgtccccggagtagcgtcttgcgtcaggccaaaatcgctaaatttcatccgctgattatgaatcttgatttgattttcttgtccattttgccaagtcccattcaaacttgaataatcaccagttttaatctggccgagcgccattgtcgacttgcggtttcccgtattggcggcggtcgtttgacgttcaaaaacttttacataagaattattacttgtgcgcgttatgattcgctcagtatccgtcttaatggtggcaggaacgttatcaccccagccactgattgcaactccctttggataaaaccagtacgtgacggcagctgcaccgatatcaccatcgatatgcagtgcgcctttttcctgtttgatggtagtagtaacagcctcttcatcaccattcgcatcttcaaatttcccgcttgctaaggccatttcaccgtcactgattttcgtgtcttttacggttaatttagcgccagcctcgggagattgccaaacatcgcccttagtatcatgcttattgacactactagcaacttccttccagtcacctaacaaactcccataggagccctgactgatctcattaagattcatagtcgtagcccctcgttgttgagacgttatttttgtcgactgagaacttgcgttgactgacgtactcgttgccttagttgcatcatttgttttgtgcgccttatcagtaatcactttgggcttcactttgaccacactaacgccatgcttcttatccgcatgtgacgcttgcgaggcctgctgtgagctaccacaaccgctaataaataacagtaacagcagactgatacagacagtttcactttttttcaaaatctggtcccctttttttccgctctgaatccatggcatcgtctctttaaaaattaactaatccgtcacggcggtaatccgacggtactaacgcttacgaaaatagtgacgatagttgtgagaaaagcatattgccacctaaaacggctaatatcatgacataaacagatagtgcaaaacctaatgcgatttcagcaatgattaacgcataaaatttgtcaatatggggcttcacaacattatcaataatgatataaataaatgccagattcataatcccgatggttgggatcataaagaagaacaatccagtcatgccagaaaaattaccagttccagtgagaatcgtcaaaagcaacgtgagtagattaaagattagaatcaaattcgtaattgctgcaaattgattgataaaatcactaaattgcatcgaaccagtattaacaacgcggcgaaaggcataggcaatgctaacataaatcgcatatatcccaagaaccatgaaaaacaccagcatactcgtttttaggataaagctgccagcatgaatcgcagcttccgaactaccaccagtcaatgaactagtaaaatcattggcgacattttgtgccttacgtaagattaacgcaattgataaaaccagtaaaaaggcctcaagaccgatcgaagttagtccaaagtaccgattagtcggttcaatcggatgaccgggatgccggatcgtcatcttaaaccacgaaaagtagcttccagagaactttttgacatgttggacggtatctgtggtcaaaattttattgacggtatcatcactactacgttcaaccgtattctcggattcggcaactgactgcccttgatccggaatttcctggtttggggcaaccacagcaccacatttcgggcaaaacttcgccccggctttcagttgattgccacactgcgagcaaaaaagtgcctgcttattcatttaaacatcctccaaattaatcataaatttctcgttaatcatttgaatctaccgtttcaaacttaccggtactcgtgttgtagcgcgctagaatatcattaacatcatcatatcgataagtatctgctaaatcattagtaccactaacatagcatttaatttcatacacatccgtgtgtggttcactcgccgtataatcataatcactaatatccccaccggtagccgcggcaatttctgacacagctgtctgagctgaactagacaaatcatcataagcactgcccgtaccactctgcgattcactctcgctgttgattaaactcgagtctgattcatcactggcagtggtagctttggtgtcagtattcgccgttgacgttgtcgctgcctttttattcgcaactaacgaaattaattcatggacgttcgcgtgccccatcagattaaccttgtgcgtgattgtcgtgtcagaattacttagtttaaacatataggtccccggaaacagcggaccaaccttataagtggcatgcgcactttcggtggtcaccaattcgatgtcatttgcttccagtgtggcattttttagattggtcgtgattaacggctgcatcgtggtgacgcgtaatttgtaagttgggaatagtgtccacttagttccgatttgcttaacaacaaacgtgtgatcactagaataaccgttatgttgtaagtctgttttcagatcttgtgcgtactggggatgtttttggatataggtcattaagggctttacggactgttttgtgatttttaatccagtattatcgctaactaagtgtttcgacaatgtcgtgggcttattactagtcatcatttcgacttccgcggcaatctgctgatttttaccagtgtgatattgataaaacccaaatccacctcccacaataatgacgactgcgagcacgcttccactgattcgcaaccaccttgattgctgcgtcttagctggtttatgagcttgatattgccttgaatccccgagtttctgctccgttccactggcttgcgttcgttcagcactgtcaatatgagtcagatccgctccgcaattttcgcaaaaaacattatcagcctcattttcatgctgacaatttggacatattttcatttttggtacactcctccattaatttgacatccgatgaaataagctcctcccaacactctgatttctattctgctttgcaagctatactaattatttaatagcgttataacaaagctttaataacattatatactactaaaagaagtatttaaagacatttatagtatgttgctattttatcattaaccgtaacctaataattgctttgtcacattcaacggatcacaaattcagcatgagttcgataactgaaagcaaagtaacgtgatttaatcagcatcacgtatcaaaagctttaatgaccttataacggtacttataaggtacttacagctctgtttcaagcatagcgaaacctctaaaattagtgctaagacgcttaatggattaaggaggattcccatgttaaccgagataggcaaaatcattcggcaacgccgacagcaacacggcatcaccatcgagcaattggccgaacaatcgaatgtttcaatctcgctaatttctcgactcgaacgtggtaaggtcgataacattaaactacaaagtttgaccgcaatcgctgaaactctgaatttaaaaatagcggacttctttcgcgacgagcttctccaatcacctaatgttgttgcattactcgactacctgagtgatctgccagcccatcaacgtgaagaacttgccggtacgttactcaaactactccgactatccaaatcgtgagcattcgcgcaacgcactccggacagttagttcaccattgaaccccgtgattcatctacactaaaaaatgattcaccttcctctgacaagaaggcgaatcatttttaatttatcaagcttgttaacggtcggctaagcgcccttaaagccagcatacagttcttaatggtgcgttgtcactaataacccactcatcactgccaatatgatacccaccgccatggctttgagtggttcacgaacgatgggggtggcggtcaaagcctcgaccatcgccccacctaaatacgttacaacgagccccaatacggcgccccaaaagattgtgactagtaaactagccagccacgttgtcttcaatagcaagctcctccaatgcggtcaggcacggctgaccttttgattgagtgtatcaaagtcgtcacgcgtttgcaaattgattaatagaattcataacttttatataatggttctatccaaaaaaatccccaccatcaatgacaaaaaagctcagcaccgaccattcaggtcctaagtactgagcgattatcatgaccgctatgacaggctaatgtcccccactactcaaatccgcaggccaatttgattcgacgaccgtttgcggaacatattggcgattcaatagtgccagccactgccggacaatcttgctcaaggtaaagtcatgactgcgttgccgagcgcgcgcggcatattcagcgcgacagtcaaaatcagttaacagtggcattaagccagtaatcagagcattaacatcgcgggccggagtcaacacaccgtactggccaccctgcaagtactcggctgagccagtattccacattgagacgatcggtaaccccatcgtcatcgcttcccccataactaatggcatcccttcccaacgcgaagtcatcatgaagacactcgcctgttgataatgcgcccgtaactcagtatctttcagcgcaccccgataaataatgcggtcacgaacatcgagttcagccatcaaccgattgaacgtcgctaattggtcttcgggaccagtccctgcgactgcaatttgccaatcatcgggcaaggctcgcgcaactgtcaacaaataatcgagccccttatgttgcaggtcaatacgaccagtgtaggcaatgatatgttgcgccaagtcggcctgctgaccatgagcttgcatggtcggtggattatagaacttgaccgtatgggcgttaaaacgtgagtagccttcccaatcataatcggtcaatgtcacgaccgtatcagccgctaagagccctgcgaccagttcatcttgcatttggacgtaatactgattgaggtagatatcaacattattgtgcatccacgcaatgacattgacccgtggaaaacgctgtttgattgccggagcaaaactcgtcagtaaacctcccgggagaataacggcatcgtaagctcccgacccaatcgtcgtgagtaaatcatctatttgaggcgcataaacggtcaacggatcagcgccaaagtaattaagtaccgtcgcacttgcaggccggcgcgccgtgataagcggtgcgctcagttcatagaaagaccggggttgggccaaggagtaaaaggcaacttcggcttgcgaggtcaacgcattgccgaggaccgtcgccgctcgtttgacaccatccatcactaaattctcgactgttatcaaaattttcattagcatcgttgactggcgattaaacaaccagtcgctcctttccacataaactcggttcatggaaccggaatcgacgatgttaggctgagctgattgcgtcagacccgttcatccttaactaatcaccatcactagtatcagcttaggtagcgttattataacaggaataattaaaaaccaattaaaatatgctcacaattcacattatgctagtcattgcaagttgcttcttgattaaacgtcagttagctaggttctgattaagacgtcataggctacattccagcaccaatcagcacttgttgacataccactagtattgcttgatatacacgcaatctgaaataagtcgcccatgctgagttgacagtatccaatcgacacaattaatagcgcacaaaaatagcgttgctactggaggcacaagccagtagcaacgctattttcaaattaagattttaactgcttattttaaacccttccattgccaatcattaacttctggcaagtcagttccggcatcccggatataggcattgtgtttagcaagcatattatccatggattgaacgaaggccgcaccagtgttttccattgctggttgcgccgcaattgccgacttagctaagtcgaagcggtccatctggttcatgacccgtacgtcgaatggtgtggtaatatcaccattttcacggtaaccgtggacgtataagttatggttgtgacgatcaaagaagatgtcacgaactaagtcttcgtaaccgtggaaagcaaagaccactggtttgtccttagtaaagtaatggtcaaactcagcatctgacaagccccgcggatccttttcaggactacgtaacttcaagatgtcgaccacgttcacgaaacgaatcttcatctctgggaaactgtcgtgtagtaattggatggcagccaacgtttcaagcgttggttccgtcccagcagctgcaaagacaatgtctggttcgctatcttggtccgtacttgcccaatcaatgataccaagaccattgtcaactaattgcttagcttcttcaatgctgaaccattgttgacgtgggtgttttgacgtaaccacgtagttgatcttttcttggctccggaaaatgacgtcaccgacagctaataacgtgttggcatcggctggtaaatattcgcgaatgtattctggtttcttttcggccaaatgagttaatgcacctggatcttggtgggtataaccattatggtcttgttggaatacagttgaagccgcgataatgttaagtgatgggtactttttacgccaatcaagttcattggctttacgtaaccacttgaagtgttgcgtcaacattgagtccacaacgcgtaggaaggcttcataactggcaaataacccatgacgtccagttaagacgtaaccttctaaccaaccttcagcttggtgttcagataactgagcatctaagacccggccagctggtgcttcatattggtcactatctggatgaatgtcttccatccattgacgattagtggtttcgaagacaccatataagcggttagacatggtttcatcaggtccgaacaaccggaagttatcaggattcttcttgatgacatcccgcaaatagtctgaccaaacgatcatatcttgcttaacattcgcgccttctttggacgtatcgaccgcataatcacggaagtttggtaagttcaaggctttcggatcgaccccaccattggtgattgggttagcagccatccgactgtccccagtaggaataatttctttaatatcatccttcaaagagccatcttcattgaagagttcttttggttgatatgattcgagccaatcaactaaagcatccgcatgttccatgtcattttgatcaacaggaatcggaatttgatgagcacggaatgaaccttcgatcttatcaccgtcccatgacttcggaccagtccagcccttaggtgcgcggaagacgatcattggccatactggcaatgtcgcatcgtcattttcgcgagcatgcttctggattgccttgatcttttcaacggcttcatccatggccttagctaaggctgggtgaaccttttcaggatcgtcaccttcaacgaagattggttcccaattcatgctttcgaagtattccttaatcttagcatcagaagtccgaccaaaaatcgttgggttagaaatcttaaaaccatttaagttcaagattggtaaaacagccccgtcgttgattgggttaatgaacttcgttgattgccatgaagttgctaatggacccgtttcggattccccatcaccaacaacaaccgcggcgatctcgtcaggattgtcaagaattgccccaaccccgtgtgaaattgagtaaccaagttcgccaccttcatggattgaaccgggtgtttcaggtgccgcatgggaagcaaccccacctgggaatgagaattgcttaaagagcttttgcatcccttcaacatcctgcgtaatttctggataaatatcggtgtaagtaccgtcaaggtaagagtttgaaaccatcacttgaccaccatgacctggaccttcaacgtagaacatcttcaaaccgtacttgttgatgacccggttaagatgggcatagataaagttttgaccggcaatcgtcccccagtgaccaattggatgaaccttaacgtcactggccttcaatggccgttgtaatagtggattatcttttaaataaagttgaccaactgataagtagttggcagcacgccagtacttatcaactttttgcaaatatgctggtgatgagtaatctgttgtcatttcaaaaacactccttaatttgcttttcacttgaacgctaactgtttaaatgttttcgtttacaagttctattttaacaactcatttcaaaaaatcaacctttttgttaattggaacggtccaattttataaattaaaacaaaaaaacaaggctcatcccttgggacaccttgcttttagattaatatattttttaataatttgtacacagaatgattgaagcagcccatcaattaactttaatatgcccagaattaacaccggcgccctgattagttagtggcaaccagttcagtgcttttaatagatagcggtcccagaaatcccactcgtgcgctccagaaccgaccaaatattcatgcgaaacttttttggtcgttagaaaatgatcaaattcatcattcgctgactttaagccgtcctgatcgccaatcgccataaaaatcgcgggtaaaacgacgtgagctgccagtaaattagttacgagcacttgcaggtttaattccgaatgaccagcagctgctagatctgggccaaaaacgccatgctgatatgcgactgtttccgcaaaccactgaggctttgccggtaacttttccattccgggtcgcacattcagtccggctgataaactcacaatggccccaaaagtatcgtgaaattttagtccgttatacagcgccccgtaaccacccattgataatccgccaataaaagtttggtcacgctggtgtgatagtggaaacgtccggcgtgtaaaatcaatcaattcctgaccaataaattgactatacgtctccccagaccaaggatgatcagtatagaaactattctcgcccgctggcatcacgacagccaggttccgttcgtcggcccagcgctggattcgtgtgccactaatccagtcgacttcactacctaagataccgtgcaataagtacagggtggcaaacggaccctgaatcgggcgcggcacgccctgctcatctgggaccaatttatcagttggtaaacacaccatcaggggaacggtccggtgtaaactagccgccataaaattaatacgaatcagtgccatgacacctcagactcctaactattcgttgacacaaacgttgtatacttcatatattgataatgtaatcgcatattagacacttcaaagggtgtcccatcatctaaaaagaagatcccactcatcaggcccaccggttcattcggctgcaaatgtagcaactcttgatcagtcgtattggacgcatcggccgcaatcgataagaatgatttggtcactgcggcgtgcaaggtcttttgcacgtaattaaagatcgatccactgaccacttgtcggttcaactggggcacaagcttgattggaatatagccactttcaatcatgaaaggctggtcatccagtaatcgcagccgtttgatttcataaacaaactcgtcagcagttaaaaataagtcttgttgcaactcttgacttgcaggaatgacgcgaaagtctaataattgaatactgggcttagcaccctcagtatttaaactgtccgtaattcctaggttagttccttcatacttaaacgaagattgatttttaagatataatggattaatgaacgttcccgaaccccgcttcttgaaaatcaggcccttattggctagcacgttaagcgcgcgcttaatcgagctacgacttacctgatactgttcgctaagactacgttcatctggaagcttcttatcaacaaattcattcgccatgatccgtttattgagatcattgatgacttgttgataaactaggtcagccattgtaatccctcctttgaggttatttcatacctcaagtatagcagaattaatggcgtttgggtgaattgttccggtccatttataaaattggaccgtatttttaataaatgtgaggttaacaataatgtcaaaaaagaagaaaaaagatcaattaggtaaaacacttgttgaaaagattttggataaagcaaatatcagctatcaacaatatgaattcccaaccgaaacggaaggcgacgttcaacaattacaagtcgaccacctcggtgttgacgaacatcatatctacaagaccttagcgctgattggtaacaagaccggtcccgtcgtcggcgtcttgccgttagatgagcacctcagctataaaaaattggctaagctatccggcaacaaaaaagttggcatgattccattaaaggacttggaacggactaccggataccaacacggcgccaacacaccagttggtatttgggaaactaagaagtttcccatctacttagacgagaccgctaagcagcaaggtaagattctcgtatcttcgggtaaaatcgggcgttcaattgaaatcgacgctgatgatctacgcaagctcgtgcacggcacttttggtccaataacggagtagccccgtggataacttgatcaagaataacggcatcgtcttgctggtcatcattggtttacccggactatttgcttggttactgacgattatcaaccgacaaaccaaagcgaatctggtcaaccactacggtattaacagtcaggtctactgtggctttctgggcatcatcatccacgagcttagccatctaatcctcgcactgatttttcgccacggcatccaatcggtccggctgctcaaacgccctcacctccatcctgaagatgagtcggcggatgatctggcactaggttatgttaaccatacttggaatcggcacagccggtatcaagtcattggtaacctgttcattggtgtcgcccccatcttcggatgcacagcggcactccttggactagactggctactcgctcctggcctatttcaagccatcttcaaattagctgatacacccgaacaaccacaatgggctgcaagttttcacgcgttaaccagtacgccaacgagttggtggcaactattaatgttgctctttctaaccctcgtcattgtgattggtggcttcgatctaagtcccgctgactatcagaatagtgcgatcgggttgtatagcaccatcggcatcattatcgtgctgactaccttactgacgttcatcggtatcaccggttggatccatacgttagttacttggggactaatggtcgccattatcttgggctactcactaatcgtgtccctactagtcatgttggtaacccatcttctgaccaaccgtgcctgatttggattgccagctttaaaaccagaataagggctaaaaaggccatcacaagaattcacgatacattcttgtgatggcctttttcgttagccaatataaatggtaattgcatcatctgataacatgatctcagctcaaagaactagtgattcaactagacgtagggatgccattacgccttatcatccgccgtccactcagccttaaattggtcaacaaactcgtgcatcaccgctgtccggtgggctgccagtgctttggcagtatccgtattcatgagagctgctaacttgaacaacttttcatagaagtgattgatagccgtgccgggctggtgtcgatattgttcacgcgtcatatgttcacgtggcgcaattgccgggtcatagattttttcaccgacatgacctgaataatacaacgcccgggcgatcccgatagcgccaatcgcgtctaaccgatccgcatcctgaacgacttgcccttcaagacttaatttttgagggccgttgaaggatttgctgaatgacatgtgatcaataattgcaaaaatagccgtttgatcggcagccgtaacattttgcgcgttcaattgatcaatcaaatcttgatgcgccttcgctgggtcggccatcaatttatcgtcgatcacatcatgaagccaagctgccgctaaagtcagatttaaattcgccccttcggcttttgccagccggcgtgctagccggttgacccgctgcaaatgatcgcgaccatgcccactatgatcgtgagcaagcttttgcaaagcatacgtttgaattgccgttaattgtgtttcagttatcatacactcatcctatccctgggtctggtagtacgcccgtaacttcttgatcgttccccggctaaaggtcaagtgatcatgattgtccatactaatcacgcccttattaaaatcaaccgtaatcacatggtcaaggttgagggcataactttgaaactcattaaaaaaatgcatcgctgtcagttgttccttaatcgtatttaaattcttatgtacgacataggactgggtcgtcgtcacgattcgcgtggtccgcagcccatgttccttctcacagtagatgatatctttaagcttcagcgttaataataacgcaccacttcgaatcgttaaagtcggttcagcagattgctgtaacatacctaaccgtttttttacgacttgtaggactctttgtacttctggaacaaactttgccttatcgaacatatttgtttttgaaataaacccggttggtgttgtcatcgcactcaacgtatccgggatcatgtcatcacgcaccgtcacatagacaataaacccatcaggatcataatcacgaatcttagaggccaattgaatgccattgatttcgcgttgtaaaacgatatctaaaaaataaagatttggtccgccgccatcctttaccgccgctaacacatcggtcggctgccatactgagactaactcataattaaagtgcaatgcctccagctgtgccgtaatgatgtcgtttaaccagagacgctgttgttcttgatcgtcactgataaacaccttcatatcaatcactcttcccaatgtaaagcagattaacaaacaaaccactgttgatccactctatcccaatttaaattgcttacaatcattttatatgatactaaagccccgccattccagcaaccaaaaaaacacgtatggaccaaataactgacattacttggtccaccgcattcagcttatttttcaatttgttgtggcttggtctgtacttgattaagtcgcaataattcatccgtgcgcaatttattaacaatcagttgagccgctgcggttgttaaactgtgactgagatcctgatcagaaatcgtaattggatcatcgggatgatgaagttgattcgttaataccgtaataaaattgtcgtaagctcgcttgggatagccagtcgcagtcacttggtcgattccctgacgaattttatccagtggataactcggttttagtaagctaatgacaataatatccgccaattgcataatttgatatttcttcttgactggtgacaagatcactttatgtttgacataattattgatcattgcggcagtaactggatcagcacctaatggctgcaacgtttcattaattaataataggacctgatccatatataagtcaaagttcggtaactcgatccacttcggcagaatcacctttgccatgcgggcttgccaatctgcataagtctcattagctgccatgctgcgtcctcctctgataaataggttacattaattatacctagattaactagtcttgtaaactagatgacattgtaaatcacattaatttctgaatatggtatcatttatgggttaatgcaaatacaaatgaaaagtaggttatgtagtatgtatgaaatgaccaaaaagctccgtgtcggtgatgatgttaaagaattgattccacaagcagtgattgccggactttgggaccgtctcaaagcgatgcgcaaagagaaattattgattgatagcacgatggccatcatgttcagtgacgactacgaagacaataaaattttcttcatgacacttcaaaaatccggctcattcgccaatgaatatgaaatggcctatgatgggcccaaagacttcctcggccatgggacgattgttattatcaaagaccgtccccgtacgattcaaatgagcatctcggacgctaataaagctgaagacaccaatgacgatgcgactgatgagcaaaagtaggctcgcactttaaatcacatcatgattgctaataagctgctcaggtggtgaccgatgttcactgactaccccgcgctgaattggtacctggttatgctacagactttcagattcgtgctcactaggttgtcacgactgattgctagctctgtcaactagttgagacagcaccttgctaacagcacccctaagtgtgcaaaaaaatccgttgccatcaatgtgtatgtatcgaataaaagcaccgtcagaattcgctgacgatgcttttatttattgtatttctatcttaccttcgctatccgcaacggtttttggcaacgtcacggtcagcagtcctgcttgataatgcgcttgaatctcttcgcgcacgacattcgttagatgaaacttccggataaagtccgcgtccatccgttcgcgatggagtacgcgcccgtcatcgttacgatcgtcttgcgaccggtgcgcccgaatagttagccattcgtcagcatacttcaccgtaatagcgtccttatcaaaaccgggtaattctgccgttacggtgtaatcatcgtcatgttcaaccacgtccgttttcatcccaacgtgtgcgtttaagacgttctctgcttcccggtgagcccgcttcaataatttggtgggctttagtagatcatccagatgatgaccgaataattgctggcgcatgtcaataacctccgtatcaaatcaattcttagtaagcctgttggtgaatggcttcagcaagtaaatctaaggcatggtcacgcgtgccaacttgatccatatcaaagatgattgagtcaatgtcgccacccttgaaatcaaattgttcgaagtagatgtacgggtcttcgccttccacttttaggaaagcggcttcaatcttttgatcaaaaccggccgcccaatccgcatcgtccatctgattgaaatctgcacgggtcacgtaaccacggtcacgaattaaatccatcgcttttttgacatcactatcttgataaaccaatttcttcgaatcctcatgaatcttagttttcgtttctactggcatcattaaagatctccctttacttggtatacccttagtttatcaccattcattggaaacgttaaccatctttctcgcgattgcattattggcgcttaaaagattgccagcaggcccgctgactacgatagaccaattaattaaccgtcacgggggctgacaaaacgggtgataggccttataatattagctacttcgcgttatacttaaagtaactaatatttatgaaatgaggaatgtttctttggacagtggccagataattttaaatttagtcattattgtcattacgttcttcgtcgcagctttctttgtggcctgtgagtttgcactcgttcagacccgccctagcgctctcgaagaagaacaaaaaaaacgtgataaaccgtcaaaacggatcgcaacttctttgcacatggtccgcaaccttaacgagtatctttcaaccactcaagtgggagtctcgttagctggtatcattttaggttggataggtgaacaaacaactgaacattttgtgcttgatttcttatccctcttcaacctatccgtctcaaccgcggtattacgaggtattagtatcgtcattggggttttcctactgacctacttagaagtggtcttaaccgaaatcgtgcctaaaaatatcgcaatcgacatgccactcaaagtaatggcggttattacgacaccattacggtggttccacgtgatgttctaccccttcgtatggttgttgaatgtctcatcagctggcgtcgtcaaaatgttaggcatcccagttgcgaatgaagataacgatgtttattcacaagccgaaattcttaatctatcacgaaatgccgtaactggcggtgagcttgaacgtaacgattacctttacatggagcgggcatttgagttcaatgacaagatcgctaaggatatcatgatcgaccgtactcagctagttgtgattgatatcaacgataccgtcaagcaagccattcgcgtttatttacagaaacgctttagccgcttacccgtcgtagctaacaatgataaggacaagattctgggttacgtttataactatgacttaattcgccaaggtgaagttgacgatgatattcgggtcaataagttattgcgtaatatcattacaattcctgaaactacaccgattcaagccattctccaaaagatgatcgacaaacaaacgccgatcgtcgtcgtggttgatgaatatggtgggaccagtgggatcgtcactgataaggatatttacgaagaacttttcggaaccgtcaatgacgaaatcgacaatgtttctaacgaatacatcgaaaagcaggccgatggcacttaccgcatcagtggtaagatgaccatctacgactttgaacgctacttcaagaccgacttacaagaatttgaagattccgatgttgtcactttgaccggttatattttggataattttcctaaaatccaagccggtgatacgattcaaatcggtaacttcaatttcaaagcgcttgattttgaaaatgcttatatcaattggtttgaggttagcgcccagacggatagcacacctgacgatcataatgacgatcaaacacaagactaaatatttacacgcactacttaaaatggcacttaagaaagttgatttcttaggggccatttttttgtatccggcgaacttcaactggtcaactttggtacttttatatgataagtcgtgtgaattgccactaacctgttgtacataaattggatgcggttgatttaagggaaagcctactaaaaattaagtttatcttaagccggccgttatcacgacaaactgcgacgattcggagccgcagtcgtttgcaattaagtagtgcccagcgtaaactaaaactaatgtaaaacagaaatgaggaactgctgtgagtgaatcaacaatcaatatcatttatatctccattgaaggcaatacccgctcatttgtcaccggtatgcaggattacgccaagacccagcatgcagctgatgatagcaacccgttaattaccttaaaagaaatcaccgaacagtcagactttgccattgagactgagccctacttcgcctttgtcccaacctaccttgacggtggtaacggcattgacaatggggttaaggaattgatgaccaacgtgttaggtgaatatcttaactacgatcaaaactcacggttctgtctcggagttgttggttctggtaaccgtaactttaacgatcagtactgtctaaccgctcggcgttatgctgaacaacttgacacggacatgattgcggattatgagcttcgcgggactgccgttgatactgaacgcgtctataacgtgatgaaagaccgtttggccgcctatttagacaatcaaaccttttaatcgaattaaccaaacaatcaaggtccaagttagttttcgctaacttggaccttgattgtgttcacagcacgaagttgaccaatcacctcagtaacgacgatttcacgctattccgttgccttatccttatcaaatatcgtggggccgatgactagtgattccgctaataaggtttcattgtacaatttaaaaacgtacttctgatacttgacctctcgttgtgaaatcatatccaaatattgccgttcttgttcgagcgcattcataaatgcccgcatctctaattctttttctgcaccagtaaattccggtcgccgaacaacgtcaacccaggccggtgcaaaatcacgagtcctagtccgttgtttctgggtcatcaaatcaaaaatgacgaattctttcacattcggcggcaaatacattttctgaactgtatcaatcgcgtggtgaaccatcgccacccgaatctgatcaatctcactagttgcctcatcatcagtcaacgccggctttagcaaccagcgaaaaataatcgtcggcacgaccatactcagaataatcaacgtactggcagtcattagaaccaagttaaagtcaccacgtccgaccgcagtatcggttaacgtataggctaaggccagcgttaccgcaccgtgcacgccacctagcgcaaaaatccatgcgggccgatttttgaaactcaaccgcaaccgaccgtagctgtaacgcaccagcacattgctaatatacagaacaagcccaatcaacaaaaagttcaaggacccatgcccgaattgttcgttaacaagaattttgataaacatgaatccaagaaccacaaacaccatgctattaaagatttcagtaatcatgctcaccaagtcaaaagcaaaatgaacttgttgtgcattaattaaccggcttcgttgggcttccgcattatgcactaatcccgcaaccacaaccgtaatgattccagaaacgtgaatcgcctcagcagcataatacaaaataaagggcgtaatcacgtacatcaacagcgacgcattcaacgaattatacgaagagcgtaacaatacttgccgaaacagaaccatgatccaggcactgacaaaaccaaagagtaccccacccacagctgaaataataaaatcaataatcgtttgcccatagttaatatagccattagcataccagagaaccgccatgttcaataagatgatgccagaagcatcattaaacaacgactccatttttaaaaaagttccctcagttgatggcatctccaaaccgttcgtcaccgattccattgccgtggcgtcggtcggcgtactgatagccgctagaataaaagctaacggcaagccgactaatcccagccctgccaagctaaatcccgcgacaattaaggcaagaatgactagtccaactgtcgtttggataatgtgctttaattccttaccaacagcattcagtcgagtggcttgtccttcaaaaaacaggagtggcgcaacaatcaggccaataaagatttcagaattgaagttttcaatatgattgctcaaaactggaataaaaaacaagccaataccgacgatcagactcaagtagttcacagatatttgcggcattacccgggaaataaaaatactaacaaccgcagccaacaccagaataaaactggaaaccatcaaattcacgtactcacctcattttattaattaattcatttattctatccgataatgctcaaattgtatcgtcaatcgtctccatcatcactttcaaagaatcaaaaaagctttcaaggcatttgaccttaaaagctttgttaatatcacggggcccacctgctccttaaccatttaataagtgttctcgccgggcgcgccacaagactaacgccaaactacctaacattaagatagtcaccgtaataaacaataacgagtaggagaactgagccaccatcatgccaccgaacaatggtcccacagctcgtcccaatgacaaagccatgttgtatcggccttgatattttccgcgctgatcatcagccgccatatcatcgacccaggcgggtgcaatcggtaagccaatgacctcaccgatcgttaaaaccaccatgataataataaaatcaacgtattgccgggcaaatactaatcccaagaatgataaggcaaatagcgtaatgcccaagccaatctgagtgccaatcttaaatcgttcgttgaataacgccacgatcggctgactcacaataattaatagcccgttaatcgtccaaacttcactataccggcggaacggaatccccaagttggtcatgtgcacggaaagaatactttcccataaggcataactcagataaatggtgaaaatcatcaaacaaatcatccagattaattgacggtgatttttaggcgtcacatcccgcttctgtggcgcagctttctctgtccgaacagtcggtgtgacgttaaaggtacttagcgtaatcgtcataagaccaaggtagcaaactgttgccaccatgaacaccacattgatacctagttccaacaagtaaccgaccaataatgtcccaataacgaccccaacgttgagtgctaaataaagcatgttaaaaacataccggttggatctagtcgttaccgttgcggcataggcattgacgactgtcatgctgataccatcaccaaagccgacaatgatcaagccaatcgcgtaaggccacaaactatgccagaaaatcaacgttgttaaaattgcggtcgaaataccaccaccaagtagcgctgtataatatggtcgccagtgatcaaacaagcgcccgccaataaagttaccagcaatcatagccaacgacatcaaaaaaagaataattcccgaaaacgtcaagctttgtttgagataattatgcatgtagaccgttgttaatggccacataaaagcggcacccgcattattcagcaaattggctagaaacagccaccgtaaccgaacttctttttgcatctcctcaccacatttctgatttaagtttattcattgagaaaacaataccctaaatagtatacgccgcctgaccgtttttacctaccaatcaggtcgcaaaaggtgctgagtagtctacgaaatcatctttacttaagccgcgcttagcatcaagtcttacactgcatgttgtttacaatcgcaacgctgtagtcgcagcctaggcccgtgctttgaccatttggtgcattctaaatgcggcccccactccgcggatccgtttcatccgttttagtattgttccgagaagcactgaccacgtgtatactaaagtcaaaaaggagcaattgacatgagacttttcaccattccagccgaacaaacggcatttagtaccaaagaggttgtcgccatcaccggtatgaccaaggacgccctccgttattatgaacaacaacagttgattgggcccgtaccacgcaaccacaacaactaccgacagtattcacgtcaaaatttagagcgtctacaattcgttgccacttttcggcaattaggccttgatctaaaactactcagcggtgacggccacattccaaaccgggcccagcgaatccaagaactgagctcatatcgtgctactgtgaaaaagcaaatcgctcaattacaggcaactgatcagtttttagcacataagattgcttactttgaagcttctccaaatcattaaccaacttttttactttttacttgctatcgtgtggacaccatagtttatactaacggcacacttaatcaaagaaggttacgatattatgaaaacaattgctattaaccaatacggttccgaagatgaatttacgatggtcgacatgcccacgaccgaaccacaagctgatgaagttcaagttgcgattcacgcctttagtctcaatcccatggatattgctggccggatgggagccctatcctcaccctttactgacttatgggcctttccattggtcttaggttgggatttcgctggtgtcattaccaaaatgggcaaggccgtcactggttttaacatcggtgacgctgtgtttggttccgccgcgcctgcccacgcagctaataacggcacttatggtgaatttattactgttaatactaaagaattagcccatctcccagcaggcttatcatttgatcaagctgctgctttgccaatcgctggactaaccgcttattacggcatgaagcacaatcttaagctgcaatccggacagaagattctggtgcagggtggagctggtggtgttggcctctttgcaattcaaattgctaaagcctttggcgcttacgtcgcgaccaccgctagtgctaatcaccgtgacttgttaactcgcctaggggccgatgaagtcattgattaccacgaaaccgatcctgccgccgtcttgcacgactatgatgccgtttttgacaccgttggtgatattgatactggtctcaaggtcctaaaagctgacggccagctcgcaaccattgccggccaaccgacggacgagcagcaacatgatcaacagaaaaaagttgcctttcagttcacccaaggctcatcacaagacctagccgacttagcccaattagttgtcagcggtcaagtgaagctaaccgttgcgacattaccgttctccgtagccaatgtcattaagggtcatcgatccatcgaaagtcgccatacgacgggtaaaatcgtcattcacgtgacggattaaccaatcctgctactcgataaatatcttccggcaccattcttagtagctagtcccactgtaaaaatgaacgttcagagttcgaaggacttctgaacgttcatttttattttagcggcccaattagccatggcacacttggtagcaaaccaaccaatttaatttaatgaatcactttaaacttcgcagcacacttaacaaccagttataattcacgatgccatgatgaatttggactaagttcaaactgtctcaaccaggtcgtactaatattaattcgacaatccataaaaattaatattgaaatgtccggtttttgaacctgattgtcgactaccacccctgatgattgttataatataattaaacactgccaaccggtgtaatctttcaacaattgaggtgacaacatggcgaataacaactttggcttggcgttaggcttcctagtgattctgttgctctggatctatcaacgcgtgcgaatgcctaagatgcgctcactcgctggctacatgtcgcgacgcgcgattgaaaatgaggaaacatggcggttcgcacaacgcttctattcaatgtttggcatcgaaatcttttccattttgttaatcggcgcgattattggtggtctgttcaagattccgctattgcaaagctttaattttcaagccatcgccttagcggttggtttgatcatgcaaaacgttgcaactgagcgtgaactgaaacaccagtttccaaaatctccgcaacattagtactttataattgaccatcaccacgtatggtttaatattaatacggtagtttaatctgaattaatgcttatgaacaagtacttggtttaaaatattcttagtaaagaagtgaaattgatgagtaacgaaaaaattgccttattcaccatctttggcggtactggtgacctcgcacagcgtaaactgtacccgtcactatttaagctctatcaaaagggctatctcaaggaccactttgccgttattgggacggctcggcgtccttggactgatgatcactatcatgaagttattagtgactccctagctgatctgaatgctgatcaggaaacggtgacgcaatttgcgagccatttttattatcaatcgcatgacgttactgatgctgaacattaccgaactttgaaaaaattatcagaaaagctggacgcccaatatggtttacaaggcaaccggatcttctacttagcaatggcaccaaacttcttcggtacgattgcccaacacttacgttccgaaaatattctgacagataacggttttaaccgcgtcattatcgaaaagccttttggtcatgattatgaaagtgccaaggaacttaacgaccaattaacggctacttttaacgaaaatcagatttatcgaattgaccactaccttggtaaagaaatgattcaaaatatcacggccattcgttttggcaataatatttgggaatcattatggaacaaccgttacatcgacaatgtccaaattacgttaagtgaaaaactgggtgtcgaagaacgggccgtttactatgataacagcggtgccttgcgggatatggtccaaaatcacattttgcaaattttgagtctgttaacaatggatcaaccagttgaattcactgaaaatgatatcgacgtggaaaaggtcaaggctttacggagcttacgaccacttaaaccagaagaagtcgcaaccaactttgtccgtggtcaatacggtgcaggcgatgatgctaaagcttaccgcgacgaagataagatttcatcagattctaacaccgatactttcgtcgctggtaaagtcatgatcgataattatcggtggtccggagtgccgttttacatccggactgggaaacgcttagccgataagttcacgcgaatcgacgtggtgttcaaacggccagtcgtcaatatcttcaatcatgaagacgtccgagctaatgacgacgcagcaaccagtctcgatccaaacatcttgacaatcaacgttgaaccgactgaaggcttcgagctccgcatgaatgctaaagcaatcggccaaggcttcgcaaccaccccggtcaagttgaattattcacacgatgctgaagccacggctggtagcccagaagcttacgaacgtttgcttcacgatgccttaaatggcgacgcaaccaactttacccactggcaagaggttgccgattcgtggaaatttgttgacgtcattcaaaaatactgggatgaacatcaacccgaatttccaaactaccgccctggtacaatgggaccagatgcggccgatgaattattacgtcaagatggtcaccgctgggtctaccgcaactagccgtcctaacgtagtcacttaaatggcttaataaaaaggaccagttaccaacacttgcctaacaacgtgttgataactggtcctttttatatcgctttaacaattgaatgggttgctgcccgtcggcaatacacgtttattttgaccttcgggattgcgcctgcggattagcttgactagcgccgcaataatccctaacaccacccgttccgcttataaacgcctaccctaccagttgttcacaaacttgaaccaaccgtttgacaccggtcgtcaactctgacagtgtcagcccggcaaaccctaacaagtaataatccgtcgtgggcatgtcgcgccaattggagttaagcggataaatccgaacctgttgctgttctagggcttctaataatttagcctgtgcaatgcctggaatctgaacaactaagtgtacccccgcgccggttgcaattggccggatccgcttagtttgcgctaactgttgacaaagtacccgatacttttgtcgattagcagctcggtttcgactaaggtgccgataatacgccccatcttcaaaataattagccattgcttgttgtaacaggccggccaccatttcagcccgatattgatactgttgatgataagttgccaccagttgtggtggtaagaccaaatatcccatccgtaatgtcggatcaatgccccgcgaaaatgtccccaaataagccacctggttggccgttgctagtgactgtagcgcgggtaatgggtgcgcactgtagcggtattcactatcataatcatcctcaatgatgagatgctgagtccccgcccattgtaacaacgctaatcgtttctcgatgggcaagacgactcctaatggaaattgatggccgggggtcgtataaatgatctgaggattacgctcacgaacttgtgtcaaatcgagcccatcttccgtcactctgatggggaccgccgtctgtccataactagccgccaattcggataaaccgcggtagcccggattctcaatcccgaccgttccgcgtggcaagatactaagtagaatactgagacctgccttagccccactcgtgatgacaatctggtccgctgtgcaccgcacaccacgagtcgttttcaaaaatcgaaccaagttttcacgtaaagccggtaagccctgcgcatccggataaacggccgttggttgctgctcagtctgacgcaacgctagtcggacagcccgtttccaagcgttccaacttggcgataacaactgagtcacaccataccgaaaatcataagtgaacgccctgggtttagtgggctgtggcacagtctccagcgcctgtttagctgctggccagtgtgtccgattgcgataaaagtagccactcccgggaacggtataaacatagccctctgctagcaactgatcgtaagcttgttcgacagtggtcttggaaacacccaaattttgtgccattttacgaattgaccataactggtggttagcttgagtagcatcatagtcatcacgcatctgctggtataactgaatatataacggtgtcgttgactgacgatttaatggcatcacacaactgtcctttcatttttatcaaaaattgtctatttctaaccggacgattgttgtttattataaacggtaatcacgttgagaggaaggtcctaatgatgaatacaaatattcggatccaacaaattcaagtctctggcatccgacgcttcgatgaagcgatcagtcaaattcccgatattatcagattaacggtcagcgaacctgacttacccaccccaagtcacgtaaaaaaagcggcaattcaagctattcataatgattggacacactactcgccactaatgggctttgccgctttgcaagatgctgcgagtcactactttcaacagaaataccaactcacctatgcacctgagcaaatcattgcaacagtcggcgctagtgaggccgtggcaacgaccctgctcactttacttaatcctggcgataccgtcttattgtcaacaccggcctacacgagctatcaacccgtcgttgacatcgcaaacgcaaaattagctcccattgacacaaccgcaacgggttataaattaacacccagtgcgttacaagctgcgctagatgatcaccgtcgcgaccacgtcaaggccttaattctaaactacccgaccaaccccaccggcgtcacgtacactgatgatgaattacgggctttgcaagccgtcattgctaccgccggaatctacgttattagcgatgagatttacagtgaactaacctatgaacagccccatactgcttttgccacactatatccaagcaaaacgatcacaatcaatggcctctccaaatcgcatgccatgactggttggcgactgggattcatcatggccccaagtaacttgattaccgagatgaagaagacccaccagtacctcgttacttcaacgagttcaatcacccaagcggctggtatcgaagcacttacccatggtctggatgatggctcagaaatgcgtgacgtctatcaaacacgccgcgattacgtcgtcaaacgtctgagtgaaattggattcaattatatctatccgacgggcgcattctatatctttgtccagctaccacaggatttccaaggcaccagctgggactttgcgacccgactcgcacacgaggcccaagttgctgtcgttcctggctcagcatttggtacgagcggcgagggttggttccggataagttatgcagccagtcaatcggcactacgcgaagggctaaatcgtttagccttatggcgcgcccaaactaccacacaggaggattagccacatgaaattagcatccgcacacctgattaccgccatggtcaccccatttgatgaccaacaacacattgatttccaccgcttagagcaactgatcgaacacttacttgcaactggcacggacggcttattagtcgggggcacgactggcgaaggccccacgttgagcatcgctgagaaacgagatttatacacgcagacagctaggatcgttgctgggcgagttccaatcatcgctaatacggggaccaatgacactgccgccacaattcatttcacccacattgtcagtcaaatcgagggcatcgacgccgccctcgtcgttgtcccgccttataacaaacccaaccaaaccgggatgatggcgcattttacagccattgccgaaaaatcagacttgcccattataatttataatattcccggtcgcgtaggcgttaagatgacggtcacgacgattctcacgttggcccacaaccccaacattattgggatcaaacaatgtggttccgatgaagaactggccgcaattgttgaaaaggcgcctaaagattttctcgtttacacgggcgaagatgctcagagcttgaccaccctcgtcttgggtggtcagggaacgatttcagtggcgagtcatttatttggaaatgaaatggcgacgatgcgccgcaccttgaaccacggcgatatcacccaagcagggcaaattcaacgacgtttaatgccgaagatggcagcactattcacacaaccctcaccggcacccgtcaaagcggcgctgaacgcccaacactggttagtcggaagcacgcgcctaccaattttaccgttaaccaccaatgaacaaagtcaactactcaacagcttaaaataatgcagaacggttggtagtacctggcaaaagcgcgtatactgaacctaaaataattaggaaagtggtgaccatgatgtgcggttgggcttttactggcggtatgccctttatgtggatgggtggcggcttgggcattatcagcttactgattctgttagccgttggtgcttactttttagggacacgttcacgccatcacgattaaagttctcattgggataatcaaaaaaagactttcaaggcacggcttgaaagtcttttttgtttcatcatcagggatcagccaactgggtcaagccctccccatttcaggtgacctgcagttttgcctgatagtatcagtccaaacgctgatttagacccaatgacttaatttcaagatcgtaacgtaagtaagtttaccagccttaacattgctattgagtttgtccccactaacttcattttcactcacaatccataagccgatttgaacaaactggccgccagtcccaatgccccgattccaatcacaattttaagtaatctggcaggtaagtggcgtacaattcgtggtcctaagctaccaccaatcagaaacccaatgcctaagggtaatacatagcgccactgaattggcgtttgcaagccataaacgacggctgaaacaatattggctaatcccaacgccagatttttctgagcattatagacgacgaatggtgcggcactcgtgaaagacaggatcgacaacatcaagacaccacccgcagcaccaaaataccccgtataagccccgactaaaaagatgcccaaccaagctaaagccggcatccatttaggtgtcacaacaatttcaccgggctgtttaatatgaatatgacgaggaatcagtactaaaattcccgcaatcaaaataaaaaatgggacgaccttcgcaaaggtcgctgccgggataataaataacagaattgccccaacaatactcccaactaaagtcagtgggatgagcgtcttcaattcctgaccatgcccccgtagttcccggcgtgaggctggcacggctccaaagctagtaaagactaagcccacggtgttagtgacattagccgtaacgggcggcagtcccagcgccagtaggaccgggtacgaaaccagcgacgctaaccccgctgcagtgctaacgatacccgcaacaatcccaacaacgactaaaataacgattaactctccgaacgtaaacatgtgcaacgttcccttctctcttaatagccctacaatagccacaacgattaccatagtcaaataaccatgttataataacaaatcataatactaacaattaagcattaattaaataaggactttaagatgaatattaaagatttgcaatattatgtttcgttaactcagctgaaaaatttttcattagttgcagcccaatttcacgttagtcaaccgaccatttcggctgctattcggcgattggagaccgaactgaaaacacaattactaattcgggctaatccccacttacccgtggcactcaccacgaccgggattcaagtccaacgacacgccaatcagatcctattagagcaccaactgatgtgccaagaagttgcccacaccacaaccgatcaacttgtcatcgggatgccgccaatcattgaaatcaactactttccccggattgcaagccaattaccacaagctttattcagccagattcaacctatcagtcaaggttcactcgcggcgctcaaaggattaaaaaacggacaattagacttagccgtacttgcttacctcaatgaattcacggatacgaccattcaactcacgacgtttgacacccagtcatttagtattgttttaccaactgacgatccgctagcaaccaactcacaacttcagttcagatcgttgcgtcatcagcattttgtggcgctcaaagataactttgtccaccgccaggcgtttcgtcaactcagtcatcaaaatcatgttcggccaacgattgtctttgaatccaacgaaatcggcagtatcttaaacatggttcgtcagcatgtgggcattgccttattgagtaacgccgtccaattaccggcgggattacagcggctccccctaactgacgcgcaagcgcccacgttcaatgtcggcgttgcgtaccgccactcaatgacgtttagtccaacccaagccgacctgatccaacgactgaccgctgcttttcaatccgtcgattggcacgcatactaaccagcacctaaaaatccaccgtgtaagtttatcaatatgataagctcacacggtggattttataacgactgtacgtcaagttaggtcgccaaatgcaggtcattaaacagacaagttttagtaacctatcatggtcgctaacccgtctcaacctcagattaagcttgttgaacagccttcgagattggggtatcgccattgatcaacgcaatggttttaccgaccgttgcaggggtgtgtagcgtttgaactgtaaaagttgcgacatcatcacgcgtaatctcaccgccaacgtcagggttaacggttactttgccagtaccggcatcattgatcagcgtacctggttgtaaaatggtgtaatccaattgggttctgttttttaaccattcgtcagcataatactttgccacgtagtacggttgtaatgctcgtggccaacgactccgatccggtgtaaattcagcactaataattacgtagcgtttaacgccggcaattttggctgcgaccattgatttgacagccccatccaagtcaatcattaaagtcatatcataacccgtttgaccacctgatccggctgcaaaaacaatggcatccataccattaaaagccaacgctaaatcttcaggctgagccatcaaattgaattgtactggctgcgcaccagcatcctcgaaagcctcagcctgttctggttggcgaatacccgcgtacacttggtcaccttgggcaactaacttggaaacgattttcttaccaatctgcccatgggcaccaatcacaaagattttcatctgggtcactcctgtcctttagttaagtttcattataaagcttaccaggacaaaaaagtatcattctgttcctgatttgtccagtttacaaaattggcttataatatgagcatctaaacgagagtagtgataattcatgtcaaaatatattcgtcaagctactagtgctgacttaccagccatgatggctattatcgaacagggcaaacacgccttggctgccgatcagattccccaatggcaagatggttacccgttagctgctgatattcaggctgacattgatgctagaattgcctgggtactcattgtcgatgatcagattgctgggacggctgcactgctaacaacacctgaccccaattacgctattatttatgatggcagctgggcgcctactgagaaccaccgctatgcctcgattcaccgtattgctattgccaatggttaccacggacaacatctgactgacttttactttagcaatctcattaccatgagttaccaactcggctttcgtcaactccgaattgatacgcacttgttaaacaagcgaatgcaacacattattaccaaagctggcttcgaataccgtggtatcgtctacatgaatcatgacaacaacgatcaacggaatgcttatcagttactactatcctaatatttgtcagccacgcggcatttggctttaaacatcacgaacgctttaattaagaccaaactcaacaaaaagcacgccagattattctgacgtgctttttccaactttgtaagcaccacctgacagccaaacttaattaactggcacaaacacctgttgtggcagtgagtacaaatactgtttagtcacctttcctggatacatcgacgctagcgctgctgcatatagtttaacttgaccagcgtagcgcgtcttcaattcttcaggccgcttgacgtggtccgtcttataatcaaacaaggttaacccatcagccgtttctaaatagccgtcaataattccatgaatcaggacttttcccgtctcatgttcatcaacatcgaaaatctgacgtgctggaatcagtaacgagaatggcacttcgcggtgcaccttcgccggattatccaaaatttgactgcccagcgcactctggtaaaaagccacgatggtgtcaactgcaatcaatttcgcgacattggtcgttaagacccggttagccactaacccatcaatcgtactttgaaccgtcgtttcattgaccggtttggtcaaatcaagttgttctaaaactaagtgggtcgcactcccaacttccgcactggttggcgcctgcatagtttgtaaaaattgtggtaactccagtgaccctgtcacaaaccgggatgtcggtcgtgaacgccgctgactaacagtcgggttcgcattcatcagcggagtatccggatcttcaaagattcgtttcacttctgataccgattgatatgccgtcgtcgtcgtggaagcctggtgtggataatgaaaattcagtaacgtggtcagataatcacgcgttacttgatcaacatcgatggtgacttgctgttcaactagttcaagcgcatcaggttgagtacccgataccgcttcactttgctccgccaggacggtggtggcatctcccaattcaacggctagcttggtcggatcatccgtcaattcgtaattgggccattcatctccccaatatgccttcatggccggatgccgtatcacggccataccgacccaatctaattgattagtcgccgcaatccgtgcttgggcacttaagacgcgcccgtcgctagcaaaggcctgccgccatttttcggtcgcggtatcaatatccttgattgttccaaccaaatagagctgttgctgagctcgcgtcatcgcgacatatagtttccgcatctcttcagcgcgcatcttcttgctgactacctgcttagtcacaacttgtggcaaggtcgggtacttcacacgcgtttctgggtccaaataagtaatcccaatccccgcttctcggtccaatagcgcgcttgagcgcgtatcagtctgattgaactgcttatccatatccatcacaaaaatcacggggtattcaagccccttgctaccatgaatcgtcattacgttgactgcttccgcatcagtctcggccacggcagctgccaaatcctggtccttttcctgcatccggcgaataaaacgaacgaactgaaataagcccttaaaactgccctgttcatacgtataagcacgttcatataaagcgtggagattagcctgacgctgtttaccagctggcatgccgccaacgtagtctaaaaagccagttcgttcatagatttgccaaatcagggttacgatttgattacgtcgtgccaaatctcgaaattcagtcagttgtgtcaagaaggtctcgatcttagcataaacttgatcaccatattcagtcgccggaccagttggataatgatgataaaagtcctggacggcttgaaaataatcactcgttttattctggatacgcaaataaactaattgattttcgtctaatccgacaattggcgagcgtagaaccgccactaacggaatatcttgatatggattatcgataatactgagtagtgacatcatgattcgaatctcagtggtttgaaaataattctgggcatcattgaccacaacgggaatgtgataccgtttgaaaacatcaataattgttaaattatgattacgtgttggcactagtaacgccacgtcgctgtaacgaaacggccggtattccccattagcacgttcatagattggcttatcttgggccttaagtgccaaaatcttttgggcgaccatcgtgatactcccaacggcaggatcatcaattgaaaaattggtttcatccgtggagacatcttctgtcgacttgtcagtttccgtctggtaaagtaatagattcgtcgtttgtggcatatcggccggataatccttgggcccatacttgaggtaagccgcttcatcataatcaatttgcccgaccggcgcgtccatcagctgactaaagattaggttagtcaaatgatcgacattcgccaccgaccggaagttttcagctaatacgattcgttccccgtgttcgggattcgtcccaaaatcgtgatacttgtgcaaaaataataacggatcagctaatcggaactggtaaatcgactgtttgacgtctcccaccatgaacatatttcctggctggtcgcgcgccaacagctgcaaaatactttcttgcaaagagttaatatcttgatattcatcaaccataacttcttcaaattgggcccgtaactgcgccaaagctgcctgaccactttcattgtcactcgttaagatttgcaacgttaggtgttccaaatccgaaaagtccaggacgtgtcgccgccgtttttcagctgcaaaagccgtcttaaactgcttggtcgcatccactagctcagtcacaattgactttgcccctaccataatatctaagacttgctgctcatcggccgcaaaataggtctcactaagggtgatcatttgtttcttgacaccgtcaacaaatgtgcccatagttttggcccgtgcagtcttctccggctcgtccttataagtttttttgagagctccaatcttgaaagtggcgacttgagtacgtaactcattccaacttgccgttgccaattgttcacggagcgtcgtcagcgttttttgtgctgtagcgagtacctcaagcgttttcgggactaagtcagcatccgtcgcaactttttgtgcctgtcgtaatttcatttgcatcccatcgacttcattaatgagcaatggtaataattgttgttgataaaaggcactggccgttaacgcttcctcatccacctgataaggttccggtaacttgctcagccagccttccggatccggggtcgactgggcaaaatcaaataaccgaaaaatcaatcgactgagaccatcatcacttcgatcattagaaaaattcgctgttaataagtcaaataacgtaccatcttcatcatataattgttcacgaacactgtcccaaacctgatcacgaatgagtaacccttcagtgttgtccgtcaataggcgaaaaacaggatccaaatcaataacgtagtaataacgctgaatcacgcggagacaaaaagcatccaacgtactaatgttggctaccccgagcaaatttaattgctgccgtaattgccgaatcgctggtgacgccgtggtttgcgccggattgtccgtcattaactgtgagatttgcttattgatttgcgattccagcttttgtttcatatgcttggcagctaagtttgtaaacgtcaccacgagtaactggtcaatattcgttccggccaatatcttgcgcataatacgttcgatcaatacggtcgtctttccagaaccagccgaagctgaaactaacaagttatttccctgctgtgcgataacagcttgctggctaggtgtatagtttgtaccctcactcatggttttctccacctttctgtgtcttcagtaaatcaagaacctgtttggctgataatggcggtagatcccgataagcattttctgccaacattgcatcaaactgcataattgatagatacggcgaatactgtaaagcagtcgtcttatcgttcagccgaattggatttagttgaatttctccagcgaaaatcgcttcagcagctgcaataatcaattgactattatgctgtaataatcgttctaactggtcattcgtcaccagtgaagctgcacgccccccactatacgccccatcctttttacgtgcgaatgggtaaactttcgaggtcccgttaccttgttgtagttcgctatctaaatgttccaatagctgcggatcatcgagcaaaattcccttatacttattcttctttagaagcgctgcttcaaaaccgccctgaatatcttttggtttcagagttggattttgaatgtgcatgtaaagtgcgccggctaatttaaccgcagcttgatcagaaccgactaaagcttgctcgttgtgcagcacagcatccaaataagttaacatttgcattgcgagaccatagtaagcctcttgaaaatcaaatttatgttgggatgacttataatcgacgattcccaggtaactttgatctgccacttggatttggtcgagacggtcaattttcccccgcacgtgcacactatgcgttgcatcaatttgaaaatcgagcgcttttaatccgtgttccttgccaacgttaccgaataagacctcggtttgcttcggttcagcggctgacagtttactttgattgcgaatcgcaaacgcaatctgccggactgtgttgattaactgccgttgcaagtaagccatccggttagaactcgtcaaaattgtaaactgtggttgatctaagatttgacgggtcacagtctctaaatactgtcctaactgctgatcactggcttgggccaatgggatttgatcagaccgtaacgccttgatgagcccatctaagacagcgtggaaaaactccccagtactagcagctgataactcgaacacatcacgctcacgcagtttgagcccatatttcaagaaataagcgtactgattacgataaaattcttctagttttgaaattgacgtataaatttgatgcccatacaaagcctcaacgctggctggtgtcagcttgacaggttgattgcgatagcttaagccagccatcaattgacgtgctagctcaccgaattgggggtcacgcgtcaattgttgccgtaaccacacccacaccggagcaggttgtaatggtgcgccaacacgattacggtcagtattcgtcgttaacacatcgcggtaaacctgaatcacatgactaatcgtccggcgcttagtcccaacaaatggccgcgcatcggcattagtcggatcaggcgtcccaagataagtatgttctcgcaaattgaactggcgttgaattcgccgcacatagttggaccaatttaaatctgtttcttgatcatcttttaacggggcgctgaaaaacaagtgtcgacgggcacttaaaaaggccaaataattcagacaactttcatcaccgagctgaacgacagctgaatcatttaaatagtggtcaccatctaacgaactgagcgttggttgcaaattttctttatccacatcactcaataagttgttcgtcataatccggtcaggcatcactaaatcggttgccccaaccatgaagacaactttatggtcctgactttgaaccattccgctctctgaaattaacacctggtccaacgtcgacggaatttgggagtaactagcaccttcaaagcccgcttgtaatagtgccaaaaagtccgtaatttcaaatggctctgcacctaaaatcgtcacgtattcatctagcatcccacagaaagtttgccaggtctgctcaggctcggcagctgcccggacatcttggcgatccaaggcttgatcacgccaagctaatagctggtccgtaacgccctggcttgtcaaaaagttgaccagcaatgtcacggccgctttgccatccggtgcttgccgcatttttttaaaaaacggtggtaacgtttcagcaacaaagtgatgaatcaagttgatttgtcgcgaaatttcagcattttgatccgtctcgaccccggcatcaccctcggttaattgaaagtattgccaatcttccctttgtacccaccgctggccgtgataaccacttttaaggataaagttttcggtcagatctactgcttggcggtaggcttgccgatccatcggttgcccattgatatttggcatcaacagctcggttttcaacactcgcataacatcacgatattgatactgctgtgcgtcgatatcaaacaacgcgttaatcaactcaactaacggatggtcggccattgaacgctgtaaatcaacaaagtatggtatttctaattcatgaaaagtcggcgctaacatcgtttggtaggcatctaagtgccgtgtcatgatcaagaagtcccgataatgataatcatcggcgggattggcatgttttttcgcgaccattgcccgaatcatgcggccaacttgtgccaattcggtctgtcgactatcggtccggaataaatgcacattcgtattcggctcctcgtgaccggtagccgcttggggctgaccacgccaaaaatcatcgagagccactaagccgggagccacgcgcggcgtgtcagcataaatatcttggctaaccggaatccggcgaatacgggcatactgataaagccgataataaagccgaccagattgataaaataaggtcccgttttcaggcgcatgatccacaactttatgatcaagcatcaaactgattgtcacgtccgcaccctgttccagcatagtcgtgatgattccctgttcctgagccggtaattgagcaaagccagcgagttctacataaacgtgtgttccgtgcaagtcttgatgccgtaagtaagcgtttaattgaacgagaatatcagcgggcttaagatacttatccgcagtcgccgccacaaagtctttgtaaacgatcgccagatcatgtagcttagcctgcaagtcacccgcctgagcattcgctgccaattgaaccacatcttctggttgcaaattagcggtctgtaactcattaatttcacgagctagttgagtcacaaaacccgtttgcgagatttcaccaccaaacaatcgcagctcatcggcatgtcgttgtagaatgcgatataatagcatgtcaatcccagcagcggagagtcgtggcacttgataagctgcttcattcttcatcaagtaccaagcgagacgggtaaatgaaaagacctgaacctgagtctgggcatacaaatctggttgcccaaatgcctgtgccaagcggttcaacacgtcaacttcagtatcgaacttaatatggttcggtaccaaataaaaaaactgatcttgtggcttagccatcaaggttgccactagctgcgccaccatggtacggcgatggtccatcttggttggtcccaatacaaattgtaagctcaccactaattcctcctctgaactgaacaaacgttctcattaagttagtctcattatcgcatatttaaccggctaaaaaaacacctaacccgtaagttagatgtttattatcgcgtccattaaataccacgttattcagccaggcgacccgtgtgctgcacgtcttaattctcaacgttgacggccactgctgccagatgtgcgtcgaatttataatggcttatcgtgcccggcatccagtaccgttttgtcatcctgatttgaaattttagaagctttaacgaacgtggtcacggcttaatgtgggcaactcgcacggtcgcttattcatccggctgcaagtctcgacctcaaaacaccttaccgagcacccggtgacactcgccaatcctcagagtgcttaaaagacgcgaattagcacaacccccacaatcatgacgagcaagcccatcaactggacccccgaaattgggttcttttttgaagcaagccagccaaattggtcaatcattaaactaccggccatcagtccgactaaaacaatgacgaccgctaaaccagtgccaacgaccggaaccaagtaaacattacccaaaacatacagcgcaccaatcatgccaccaatccacatccaccaaggattaggcgtcttagttggcctaatcaatttgaattgaggtcgcaagactaacacgatgacgatcagtcccagagtaccaactaaaaaagaaacaaatgccgcgtgcactgtggagccaagcacccgacctaggtgcccattgaccgcagtttgcatcgcactgagcattccggcaaccacacctagtgcacgccaaattccaaggccactttggtcagtgtcagtagctgtatctttttccgctgtttcagtgattcgattatgccgctgttcgagccacccctgagccgcaacggtgatgatgactcccgccaagactaaaattgcaccccaaaatcgggtcatcgtcaatgtactttggggtgagtcgaaccaaccaaaattatcaatcaatagcccggccaaaatttgaccaagcacgggcataataacggtttgaacactacccagcttcggaaacaacaagatattgccagttaagtagacgacccccaacagcccacccagccaaatccaaaccggttgactcgtaaataacgtcgtcgaaaatcctaaagtatggacatcaattagtgtcattatcgccaaaaacaacgtccccacagcaaaagatattagggaggcaccaaatggagatcccactgaattgcgcaatcgcgaattaatactcgtttgcattggtaacccaatcccgattgctaagccaactaaaattgctaacatcgaatattccctcatttctttatcttgtcttaacaatctgtcacaggttaatattagcacgagccggtaactaaaatagtcatgaaaatcgtctggataatccagcttaattttcatgactattttaaatatgccagccatttatggcgagtaatcctaatcagtcactccccagtgttctgggtcctgacgccacgtatgcagcgaagctaattcctcgtcatcaatgtaatctgcttggcgagcaactttgattagttcaggatagttggacaaactgaacagcggtaatgacgcagcagcaaagttttgcgttgccgcatccaaggcataactgaagattgccccaacagcctgaatatcgccacctgctgcttgaacggccttagccgcctgtaacacactgccacccgtcgaaatcagatcatccagcatgacaactttttgaccgggctttaacaccccttcgatttgccggccagcaccgtgatccttgggtttagcacgaacgtagatcaatggtagatttaacaattccgccacccaggctgcatggggaatgccagccgttgcgacccccgcaatcacttcggtcgccgggtattcacgcttgatgatggcggcgattccgtgcgcgatatgctggcggaccgccggataagaaatcgtcagccgattgtccgtataaattggacttttaatgccactggcccaggtgaatgggtcgtttggtcgtagtgtaacggctttaatcgtcaacaaatcagtggcgatagttgctgcaatttcactcatattagttactccattctgtcataatgtctcggtaagcttgaactggttctgcagcctgcgtaattggccgcccgatgacgagaccgttgctcccagccttagcagcggcagccggtgtcatcacccgttgctggtcatctgactgcgccgacgctggccgaattcccggcgtaattccgagaaaatcggcaccgacggccgtatgaatcgcctgaacttcttgggcggaacaaatgacgccatcacagtcactcgcccgtgctagtttggcataatgcacgacactcgcccgaatcgttcccatgatttgctggtcctgattcaaaatagcttgattagtcgaagttaactgcgtaatcgctaataacttgggggcagtgactccagcggccattgcacccgcgaccaatcctcgtttggcggctgaaagcatcacgtgcccacccgcagcatgaaccgttgtataggttacccctaaccgcccgatcacccgcattgcggattcgacggtattgggaatatcatgtagtttcaaatctaagaaaaccgcatggccgcgagcttgcacgtccgtcacaatactcggtcccgctgcataaaataactccatgccgattttgacagtgacatgtaaatcagccggaaattggtctaaaaaagctaaggcccgttcggcggtgggaaaatctaacgcaatgataattggtcgcttcatccttggacctcctgaatcaacgcttgcaagctggtgatcccgtactgatccatcgccgccggtaatccagcaataatgtctgtacaagcagtcgggtgaccatacgttgcggccccaacttgaacagcatttgcaccagccaggtaaaattccaacacatcagccggcgtgaacacgccaccaacgccaataatcggcaacttggtatgttgacgcacgtcatggatcatccgaacagcaagtggatgaatggcttttccagataaaccgcccgtaccatgcgctaagatcggttgacgtgtggctaaatcgatgccgatacccgttaacgtgttaatcatcgtcagtccagccgctccaccagcttcggcagcgagtgcaattgggacaatatcagtgacattcggggtcagcttcatgaaaactggtttatcgaccgcggcaacaatcgccttagtcaacgccgttaccgtcgctggatcagttccaaatgctaggccgccatggtcgacgtttggacatgaaatattgatttccaataatttgacgttaggtgccgacgccatttttcgtgcgactgccacgtattcatcaaagctcgcccccgcgacactcccaataatcggtaaatccggataatgagtcgctaaccacggtaatttatcggccagcacattgtcaattccgggatttttgagtccaattgcattgagccaccccgcggttgtttccgcggtcgttggtcgtgggttgcccgctttcggttcggcggtggtcgacttgatgaccaagccccccaacgcactcaggtctaactgttgagccatctgttgaccatatgccgccgtaccactagccggcataaccggatttttgaacgtgacaccggctaaatttactgttaatcgtcccatcgttttcctcctatgatcaagcttatcggcgggtgtcctgatttagagcgcctgcgttacaaatgactgtgattctcgtacttgcaaaattgccgcgaccgtatctaaggccgtaaacaatggaataccgtgcataattgacgtgtttcgaatcagggtaccatcattttcagcctgttcttcatccgaaaccgtattaatgacgacttgaatttcgccagcttccatgcgatgcagtaaatcatgctcgccactatcgatcttgtcgacggtcgtaacgggtaacccgtgtgtggtcagagcagtcgccgttccccgagtcgctagcaattggtagcccaacgcatggaaccgcttggctaacgccactgtttctggcttgtcttcatcccggacagtcaaaagtacgttaccatggctcggcacgtgtagcttagccgcttcaaaggctttgtaaagcgcctttgccatcgtgacatcgctgcccatgacttcacccgttgacttcatttctggtcccaacaaactatccacacgattcaactttgaaaatgaaaagaccggcgctttgacgtgtactaagggacccggtgtgaccaagccagtctgataaccttgttcagccaatgactggccaaggattgcccgagtcgcaacttgagccatcggaatgttcgtgaccttgcttaagaatggcaccgtccggctcgcgcgcggattgacttcaatcacataaacttggtcgtcgtggattacgaattgaatgttcatcatcccgacacagttgagcgcaatggctaatttttcagtataatccacaatttgtgcttggaccgccgccgaaagtgactgtggcggataaacggccatcgaatcgccagaatggacacccgcccgttcgatgtgttccataattcccggaatcaagactgtttgaccgtcacaaatggcatcaacttcacattccttcccgaccaaataactgtccactaaaacggggtggtcatgcgacaccttgaccgcgttatgcatgtaatagtctaagtcggtccgcttcttgacaatttccatcgcccggccaccaaggacataactgggccggacaaggacgggatagcccaacttatccgcaatagctagcgcggttgcttcatcacttgccgtatcaccagccggttgtggaatagctaaagctttgatgaccttatcaaattcgtcacggtcttccgcacggttgacatccgccacactcgtccctaatattttgataccatggtcagccaatggtttcgctaagttaatcgctgtttgaccaccaaattgcacaatcacgcccactggtttttcaagttcgatcacgtttaagacatcttcaatcgtcagtggctcgaagtacaatttgtctgatactgagaaatcggtcgagacggtttccggattactattcatgataatcgcttcatagccagctttttgaatggctttaacggagtgaacggtagcatagtcgaattccaccccttgcccaatgcgaatcggccctgaccctaacactaaaacggatggacgtttcgtgacaatactctcattttcaaactcataagtgccgtagtaataaggtgtctccgaagcaaactcaccggcacaagtatcgaccatcttataaacgggcgctagtttgtgcgctaagcggaagtcgcgaacctgatcgattgtttcgtgccaatagtcagctaccgtttgatcggcgaagccattgcgtttagcaacagttagtgtctctatgtcatccgtatgggtacgcaaagcttgttcgatttcaataatgtgtaatagtttatccaggaagaacacgttgatcttggtgagttcggctaattcatcaatcgggtaaccgcggcgaattgcttccgttaagtagaataaccgatcatcctgcgcatgaatgagcttatcgctgagtacatcatcatcaacactacgcaaagcgggttcttcaacgtggtgcactccaatttctagtgatcggaccgcctttagtgtggcttcttcaatattgcgcccaatcgccatgacttcgccggtcgccttcatctgagtgcccaaacgacgatcagcatgggtgaacttatcaaacggccagcgaggaatcttgcaaactacatagtccaacgctggctcgaattcagcgtaagtggttcccgtcaccggatttttaatttcatccaaatgcaagccgactgcaatcttggcagccatcttagcaattgggtaaccagtcgctttggaggctaacgctgatgagcgactgacccgcggatttacttcaatgatatagtaattaaaactattcggatcgagggccaactgaacgttacagcccccctcaatcttcaacgcccgaataatcttcaaagcagcatcccgtaataattgcacttcgcgatctgctaacgtttgaacaggtgcatagacgattgaatcaccggtatgaatccccacggggtcaaaattttccatattgcagacgaccatcgcattatccgcagcatcacgcataacttcaaactcaatttctttgtacccggcaatactttgttcgatcagaacttgggtcactggtgataacgccaacccattttcggtaatgtcgtgtaactgttggggcgtctcggcgatgccaccgccagtcccccccatcgtaaaggctggtcgcacgatgaccggataaccagcttgctcagcgaaagccaacgcttcgtcaaccgtccgcgcaataccagaagctggcacgggttcgcccaattcttccatcagtgccttaaactgttcccggtcttccgcctgatcaattgcgctgagcttcgttcctaacagttcaatgtgcaactcatcgagaatacccgatttagataattccatcgccatattcaagccctgctggccgcctaaagttggcaaaatcgcatccggatgttctttgcggagaatctgtgaaacaaattcaagtgtaattggttccaagtagacctggtccgcaatttctttgtccgtcataatcgttgcggggttagaattgaccaagaccacttcataatcgagttcttttaatgccaggcaagcttgtgtcccagaataatcaaattctgcggcctgaccaataataattggtcctgaaccaattaccataattttatgaatatctgtccgtttaggcattgaattggcttcctttctgggttgcttgattagccgccatcaaatcaataaattcgtcaaaaatatgatcagcatcgtgaggacccggcgctgcgtccggatgatattgcacggaaaaggccgcgtagtcgcgatgccgcaagccttccacggtaccatcattaatctcctcatgggtgattaacaagtcagtctgcgctaatgaatcccgatccaccgcgtaaccatggttttgcgacgtaaaatcaatccgcccagttgcaatctcacgaacgggatggttaaacccacgatgtccgaacttcatcttgaacgtgtccgcaccgtttgctagcgcaaaaagttgatgtccgagacaaattccaaatagcggcacatgtttttccacttctctgatcatctctaaggctcccggaacatctttgggatcaccagggccgttcgtcaacatcacaccatccggattcaaagccatgatttcactcgccgtggtattgtacggcaacaccgtcaagttacattgacgctttgctaattcgcgtaaaatcgaatgcttcaacccaaagtcgacgacgaccacgttggggcctgtcgctgggttgggataggcgttattcgttgagctctgggcaacaacggcccgatttaattccgtgactttgagccggtcaaccgtatctggtaagacgttatcgacgatggtggccttcatcgcgcccttcgttcggatatgtttagtgaccgcccgcgtatcaatatccataatgccaggaatcgcattctgttttagataatcgtccaacgactgagcattacgccaattactggctcgtcgggcaacttcgtgaacaacaacgcccttacaagttggcttgattgactcatggtcatcccgattaatgccgtaatttccaatcaaaggatacgtaaacatcaagatttcgccattataagactggtctgtgatcgactcttgataaccactcatgccggtattaaagactaattcaccaaccgtggccgttgtcgcaccaaaccccgtgccggggtaaatcgtaccatcttcaagtactaagtatcgtttcatgcttgcgtttcctttccatatgccaacttaccgtcaactagtgtcattaagacgttgccataaacgggccaaccgataaacggggaattgtgccccttcgataacatggtggccgcttcgatttcatattgatgatctaaatcaataatggttagatcagccggtgcccccactaccaaccggccggctgtatttaagccaaatagttcagccggacgcgtgctcatcagttcaattaaacgaccgagcgtcagtaaccgggtcttgaccagcgccgtatatagcgtggcaaaggcagtctcaatcccagtaatcccgaaggctgccgtcttcatgctgccctgtttttcggcatcagtatgcggcgcatggtccgtcgcaatcatgtcgatcgtgccatccaacaatcccgcaactaacgctgcgcgatccttggctgaacgcaacggtggattcatctttaacatcgggttatccatcgtaatatcttcatcacaaaggagtaaatgatggggcgatacttcacaagtcacgttgatgccagctgctttcgcattgcgaatcacgcgtaaactttccgccgttgagacgtgacaaacatggtagtgaaccccactcgcttccgccaacatgacatcacgagccacttgggacgcttctgaaacattattgataccaggcaatcctagccgatcagcaacgggccccgcgttcatcacgccatgatgataaagcgaatcatcctcaacgtgtgccgctaatggcaacccaactttagcagcaccttgcatggctgcaaacatggttccggccgtttgaacaccggaaccatcgttactgacggcaaaggcccccgcagctttgatgccggcaaagtcaacgagctgttcactagtccgcccagtcgtaatgctggcatattgtgcgacgtgaacatgtgcttcctgctgattacgcgccaccatcgtcgcgacccgctcaggtgtatcgggtaccggatccacattaggcattgctccgaccgttgtgaaaccgccatgcgccgcggctaacgttccggtcgcaatcgtttccttcgctgtttgaccaggatcgcgtaaatggacgtgtacgtcgacaaagcccggactaacaaagtgctgatcgacacaaatgacgtgatccgccggtccaaactgatcgtgcagttgatgcccgatcgccttaattcggccctcggcaatcaggatatccgttgtttgtaactgccctgcttgccacacttgagcattcttaattaatgttgtcatgcgttaaacctccacttgagttgctgaaattaatccttgatgagcgaggacgctcgccaccattgccatccgaatataaacaccattcgtcatctgctgaaaaattcgtgattgcggcgcttcaactaagtcactcgctagctcaacacctcgattaacgggggccggatgcatgataatcgcatgcttgggcattcgtgcagcgcgctcagctgttaaaccatactgttgatggtaggcagacgcatcgaaggtctgattgttcacttgcgataatcgttcgtgttggacacgtaataacatcatgacgtccatcgttgcgactaactggtccatcgtctgatattcgccgtatgcttcaaagtcacggccataccattctttggggccgccaaagtaaacctgggttcctagttgcgtcagtaacgccatattggaacgggccacacgtgaatgggccaagtcacccacaatagctatctttaaaccatcaaaatgaccaaattcttcataaatagttagcatatccaacaacgattgtgacggatgttgcccactaccatcaccagcattgatcaaactcatgtcaaacccggcgtcgagaagtggttgataataacgatcgcgtggatgccgaaccactgccaagttgacgccaatggcttcaatcgttttcaaagtatccagcaagctttcgcccttagtcacggaactagtctttgggtcaaacggaatcacctgtaatcctaatcgtcgttcggccatctcaaaacttgtatgtgtgcgggtgctattctcaaaaaataagttcatcgcaaacgttggctgtgacagttgtaccgttttcccattcttgaaagcttgggccaacttcaagtaggccatcacgtcctgattactaaattgttcaacactaactaggttttgactcgttttcatggctattgccgtctcctttgtatataaaaaaagtctagcttccgcaaaaatgtttgcaaagaggctagactccgattaagtggtcacgcatgaccaaaccgtttcgttcctctctggaaacaattaaatggttttattcaattaaatcattcttctaatttttcaatactaattccatcatgtccgtcgtgttcttcaagggcgacactgacttgttcatccaaggccgttggaatatttttaccaataaaatcaggccggatcggtaattcacgatgtccacgatcaactaagaccgctaacgaaatctttgcgggacgtccatggtccatcaaggcatctagcgcagcccgaactgtccggcctgtaaataagacatcatcgaccaagataacgtgtttgccattgatatcaaccggaatatcagcaccatttagcttcgcttgaccggcaacatcaaccgcatgatgatcatcccgatataacgtgatatctaacgaaccaactggcacgtcaacgccttccaactgtttcaatcgttgcgctaaccgttgggccaaaaaaatcccacgagtcttgataccgataaataccaggttaccaacacccttattctgctcaataatctcataagtgatccgcgtcagcgcgcggcgcatggtcattgcatcaacgacttctcgtgccattagtttgtcagctccatttctgtaatttcaccttaatccacggggtaaaaaaagagtcaccctgttttcctgcgaaaagcgtgggagaccctacatgaccgttccccttgttagcctcacaggactaagttaaaggtgcttgtttaattggactaagtgtaacgaactccaccacaactgtcaaggactaatcaacttaagtcgcgttaattatctgacgactttggtcatttgccctttatgttgacaagcatcattgaggaacctggcgagttcaataaatttccaatcgtgacacgtgatcgtcttattccggcctctaagaataaatgatgagcggtcgcctaatattagtaccattggtcgttgaatccgttgatattagaacttcaattaaagctgggagaccatcaattcactttaatgactgtttcaatcttaacgtgctaatttagcaacaaatggtctatcaaaatatcattatatgcgaaatctaccctttatgagcaacaacaaactcagcaaaagttaagtccacccatcacttgaacaccacctcgactgaaaggcgttgctgacaatactcagcactggaagccggtgaagttcagacgggttgaaactgaagattatctcaacggcaacgttgaggggtgaactttcacttagctaactggaagtctcaacccgagcgaatcccgtttctgtatgtcggcatccaacgccctaaccaggtgaatttacactaaacaaaactttcttcagcagtcctgcgccggctactcctgcgcttaaatgaggataaacctttccaatacttaaattccttaacccataacactggttcgacgcttcatttgtttttaatctatttttcatttaattatagtcaaactgccaaattatcggtatactacttgttaaagataactaattttagggggacttaccatgcgtttacaaacactattacaaacaccatcaatgcaacatatgcgggtaattgcgggtgaacgcggtctcaaacgcgaaattagtaatatcggaatgatcgagtcacctgacattgctgactaccttgctaatggtcagtttttgattacgaacggctatcccttcgtcaatacaaccaccgacccactaactttgatcaaggcgatgcacaatgccaactgtgctggtctcggatttaaggatcatcgttacgttgaccatttaccaaaaaaagtgattgaattagcgaacgaactcgcttttccaatcattattacgcccggtgatgagttgatttctgaaaccatgcgcaaaatgctgagcatcatcttaaagtcacaaactaatgagctcagtcgcatcgtcaaggcaaaccaaacactagcggatttgttgctcaaagacccaaccaacaccacggtcttgaataaatgtagcgagctgattcatcatcctctcttcttaatggatagtcattttcgggtggtcagtgcttcccaagatttaccgatgacccgcaataccttgactgattttttacgcaatcaaaccgatatcgactatttcaacctcaatacccgcgtcattctcccttaccaagcaaatgacctgaccatcatgccactattttcggcttataaggaaaataaggcctttgtaggcgtcgtcgacttggacccggccaactcaactgatcagatgctgacgcaagtcgtcttaaacaccttgagtttcgtcaatggtcgggtggacatgttaaacgaatccgcattccgcaaccaaagtggtttctacttaaacgtaatggatggcggtatttcaaacgacctcgtgaataagactctgaaagcccgcaatattgatccgagtacgaagttccactgcgccaccattttagtcacgactaatcaccaggccctcttaagtaaccatctcttggaacaggttcagcaactgacactgtggtttattaaagaataccaagcatccgtcattgttttttcattaaagcagcaattggtcttattaatcaatgaccagcaaaatgcccagcactttctgaccgccctcgttcaatttattcagccaaagttggacagacaggcgcgtttgattgctggttacagttattcgactctaccactaaccgaactcgcaacaacctataatgaagcggcagaagccttggcactcagcaaaaacagtccccacgcagtcacgatctatcggcccaagtacgtcaaggaactaatttcactgattccacaaaatgaagcgcgatcgtttgtcgaacgggttttaggtggactcgtcagtggtgtcagtgcgaatgaacaacttaatctactcacgaccctgtatggctatttttattaccatcaaaacattgccgaagtggccggccacctagatattcaccgcaatacggtgatttaccgccttaaaaagatcgaaaaaatgctaacgttgaacttggacgatcctgaacagacccaaacactagaaatggcagtgctactttggcataatcaacaatcacaaaagtgaacgttttcattttcatcttccaaaaaaatatcgttttcacgaacattaatttattcggctacatttgtattcggttttcatctgtgctagaataagtctcattcaaataagtggtaattgcctatataatgtcatgatatggttgacgagtttctacccaaccccgtaaaggttggactataagcaaacgaggtcatcccgtttgccggggtgactttttttataggcaaatcagcttaatcgagagaggaagattgatttgaaggaagtatccgcagcacctaaaattaccaatgttaaggcggccattttagggtttcaacatctgttagctatgtattcgggtgatgtgctcgtgccattattgattggcgcggccttgcatttcagccaagaacaattaacttacctagtctcaatcgacattttcatgtgtgggatcgcaacgttcctacaattaaaacgtacaccactaacaggaatcgggcttcccgtcgtgcttggctgtgccgttcaagccgtcaatccgttgattcaaatcggtaaaacatatgggctggggaccatgtatggctcaatcattggtgctggtatttttatttttctgattgccggcttattttcaaagatcaagaacctctttccaccagtcgttacgggatcgctaatcacaattattggattcacgctgattccggtcgccttccaaaatcttggtggcggcgacaccagtgccaaggatttcggtaacttgcaagcacttggcattggttttctcaccatcgcaattactttattaattagcgtgtttgcacgtggcttcatgaaatccgtttcgattctgattggtattttagttgggactttgattgccggggcaatggggatggtttctttaaaacccgtcgctgaagctagctggttccatttaccgaccctcttttactttgggaccccgcactttgaatggtcatccattttgaccatgatcctcgtctccttaacaacgatggttgaatcgaccggggtcttctttgcccttggcgacattaccggtcgtaaaattgaaggcgacgatttaaaacgtggttaccgggcagaaggaattgccgtcatcctcggtggcttgttcagtaccttcccctattcaacgttttctgaaaatgtcggcgtcgttcaattatctggtgtcaagacgcgaaagccaatttacttttccgctgcgttcttagttgtattgggcctactgcctaagattggtgcgctagcgacgattatccccgacccagtacttggtggcgccatggtcgtcatgttcgggatcgttggcattcaagggattcgaatgttagctcaagtcgatttccgcaataacaataatttactcgtggcagccgtttcgattggtcttggtttgggcgtcacggtgcaaaccaatatcttccaattcttacctggtgcacttcaaatcatgttgagcaacggggtggtcgttggtagtgtagccgcagttggccttaacttactcttcaaccgccacgcagccgaaaacacggttgatgatgaatcagtcggtctcaatgaaacagaacaaccttaattatgacgcttaaaagcagcggttcacagtcctaatctggcagtgaaccgctgtttttttgttctgctacttaatagccgctctcattctattgattgctttatactgccattttttgctgaatgtcaaccgtcgtaccggtgaagactttttttaaagtaactttctttcgacttggcataaaacttgcccatgctgccgaagagtcatctaaacctggtccattccaaaaacaagccatcgtgaggcaataaactgattaatcccctgttaccctaaaaatcagtatgttatactagacaattgttgaattgttagttttttattaattttaggagtgggtcattattctagaacaattatttcatttgcgtgaaaaccgcacttcagtccgccgcgagttgattggtggtctgacgacctttttagccatgtcatatattttagccgtaaatcccgaactattgggaagtactggtatgagtaagaccgccgtcttcaccgcaacgattttagcggccatcgttggttgtctcttgatggggctagttgccaactttcccgtagcattagcaccggggatggggctgaatgccttctttacttatacagttgtccaggaatggcacattccttggcaaaccgctttggcgggagtctttgttgccggaattcttttcatcctactaacgctctccaagttacgcgataaactgatcaacttgattccaagtgcgctaaaatacgccgtatctgccggaattggcttgttcattgctttttcaggactacaaacctccgggattatcgttgcgaataagtccaacgcggtcgccctgggtaacttgcacagtcccaccgttttgttggcgattttcgggattatcgtcggcatcatgctagtcaccgctaatgtaactggtggtattttctggggcatgttcatcaccgccgcagtcggaatgattttcgggattattcccctaccaactgggattatcagtggggttccgagcgttcaaccaatttttggtcaagccgtgacacaccttggtaatattaattcgtttcaaatgatcattgtcatcctgacgttcttcatcattggccttttcgatacgtcgggaaccttggttggggtggcaaccgaagccggcatggtggacaaagaatccggcgaagtcaaaggcgttggtaaagcgctctttagtggtgcactcgccacaactttaggagcagtctttggcacgtcaccgacgacggcttatgttgaatcgacttccggcgttgccgtgggggcccgtactgggttatcttccgtcttcgttgccctcttgtttgccatcgccgcctttttctctccaattttgacggtgattacgtccgcggtgaccgcttcagccctgattatcgttggtattttaatgctatcaaacgtccaatacattgactggaccaagtttgaaatcgccgtcccagcctttttcaccatgattatgatgttattaacttatagtatctcagaaggtttggccgttggctttatcttctacccaatcaccatgacggtcaaaggccggtggcgtgaagtaaacgccctcatgtggacgatgatggtcgtcttcattctctactttgcatttgtcgcttagaactgatggttcactaagcaatgatggcagtctaaaacacccctgagtcgtttaactcaggggtgttttttagtaggcacggctgcatctaacgcctactagtgtttaagaacttgttgattatggtaatcttcagcgtagacttgggcaaagtcagcaagtttaacatcgcctaatcgaggttgatttgctcgataatccgcgtaaaaatcgtggtcacgctggtaagcgaccgttttaacatattcccgtgcaaatgcgaccggggttccggcagtcactaaatgatcttgcatgacctcatcaggcacttgtgaaacgcgcaaatccggcattttaagagcctgtgacagtgcggaagcaacttccaaataagttttctcatcactcgcaacatatgtcaccgtttgccccggtgtcggttcggtcagcgccttaatcagtacagttgtaacgtcgaccggcgcaacccacacgttcttaacagccaaattggcatttgtgtagattcgatgactctttttaacggttggcacactgctcagtaaattatagtacattgccgttgggcggataaacgttaagtccacgtctggtaaagcggttgttaacgtttgttcgataatatgatacatgtaaagtgcaccgacttctggtcccaagtcggcccccacgctactcagattcaccactcgttttacgccggctgccttgatcgcggcagcatagatgtccgcttgtcgtttggcagcggtataaagatcatcactcgccgctataccagttaccatgaggtataccacgtcagcgcccatgaacgtcttggtcaaaaacgcttcgtcatcaagtcgaccaatggcaggggttgcgcgaaaaacctttatcaaactactgcgagttgcttgatgactgatgaccgtcacttcatgaccagcatgggtcagcttaggtaccaaggtctggttaatacgaccgattgaacccgttaaaacaattttcattttatgataaccctcttctatatttattaaaatatccgtcaaagtcattatcgattataagcgaccactaaaaccccgtcaatcactggtggtttagttggctaaacagtgttgatgtgcggttgcgcgattcgttcataagacaggactgattaacgctaatcaaaaattatttctatttatcaagagataatttttgttgaaactgtgcaaaattaggcctataatgtcaaaatgtttgacactgtcaactacgacggttagtcgcctttcctgttaccataagtttttcttacggagattatattagatgagtctagcacaattagaaataggattactgtggttgacaggctcaattgcggtcatcttcatcctgacgattgatacttattattggtactcccgcaaacgttccaacaattaccttgaaaatgatgattttaatctacgctactttattcaaaaacaagtcgattttcgtggccgcactaccggctatgaatgtctcctgcgtcaacaaaatactgatggttcgtggtcattaccaccacaacttgactcacttccacttcagcgggtgatcttcctgcttgaagatacctttaaggcgctacctgacgaagcgattacgttatcaatcaatttagaatacgaacaaattatcagtcccgaattccgttattttgttcgctgggcaattgcgaacatcgaaccgatgcacttggcaattgagtacacacctcaataccaaccgcgtcgtatcaataaacgcctatttcggcggcgaattcgtgaagcccgcggttacggcatgcagttcggaatcgataacgtcggtgcaagtctagccaatcttaaaaacattcagtggcttttaaaagatatcgacacgctcaaatgctcaatgcgctcatttcgcaaagaagacccatccgtctggctggacctgaacctccaattctggaatcagctctctaaggaaaacaatattgatctaattctaatgggaatcgaaaatgaggccgatgaacagctcgccgagcaactgcaaatcagcattcgccaaggctacttattcggccatccaatcaatccccagcaatcaaccacaaaggagaaccacgatgcctaaaccaaccactgatgatgttaatcggcaacaactatactctgatgcgtactttgacactggccattggggactcaaggttcgccaaacgatcgttggtatcgtgggttggatcgcagtgattgtgcccatcaccgtgacagtcctttccatttggtcaagttataatccacacattccgcgtttctggcactaccatgaaggtcttttcgaatttaagttcatcggtatcttactggccttttgctttgcactcgcatccctttttgcagtgaccatgaccattatacagaatcgtaagcgtgaacgtgtcgttgaacagtggccaacctttaatcccattaatcagaaaaaacggcagcaactgctcgctcagttcatggcggaccgtttcggcaatgccgaatttcgtgaacatacccgctactaccgggtcaagccagaacaaaatctcgatactaatcagattcagcaactttatcaacaaaataatttagacgatattaacgattaaccagggggcgccatgacaaatatttttattgaccacatattcgccgcaaccttatttaaatcggtaatcaacatcgcactcctgattttatgcctctaccccatcgttggctcttttttctggttcgccggcgcgctatcctaccgatttatcaagaccaataagcgtgatgatgactggcagtacattccggctgaacagcaaccaatgattaccatcatgatcccggcgcacaacgaagaagtcatgattgaagaaaccatcacatacttatttacccagctcaattatacgaactacgaggtcctagtcatgaacgatggttcgaccgacaagacggccgccattattcaacggttgcagtccgtctatccacggctacgaaccgttgaaattgagaaaaacaagggcaaggcccacgccttcaatattggcatgtactttgcccagggtgagtatattctcagcaacgacgctgatacgattccagaaaaggacgccctgatgaagtatatgaatttcttcatccatgaccgcgatatgaatacatccgccgtcaccgccaatatggatgttcaaaatcgaacgtcgcttttaggtaaatctcaaaccgttgaattctctagtatcgtcggtgttatcaagcggagtcaaacttccatcaacgactctatgtacgcgtatagcggggcaaataccctctaccgcaaacaatttctaattgacgttggtggctttcgacaaaatcgcgcgacggaagatatcagtattgcctgggatcaccaaatggtgggcgccgtcccgcggtttgcccctaacatcgtcttccatatgaacgtccccaccacaatccgagacctttatcatcaacgcaaacgttgggcacagggtggcacggaagtgtggttaacgaacattaagaaattcattttccacccaatcgttcatcgctatcaactatcaatgttcgtcgattcgacgttgtcaatcatctggtcctttttcttcgtcatcacttccttgatgtttttgattctgatgggttccttcctgataaccggcaattttgaacgagtctaccacggcttgatgttgtcatttgtctttgttagttttgaactattggccgggttcatgcaactgttagcggcactcctgttggaccatcatggtgcgaaactaatgtactggttcttcgccccactctacatgttattttactggatgatcaatcctatcaccgtcgttgcaacgtttattcctgcactcaaaaccattctgggctttggctccggaacgtgggtcagcccgaagcgacagtcattgcagggtaaaaagtaaaacggtgtcgctattaacgctttcaataatcgataacgggtctactggtgcgagaacttgcttgcaaccagcccaaccaaaaacgtgcacttacctgagtgatagctgactcaggtaagtgcacgttttaatattaatcccttttgatcgttttcttagctatgcaaacggagctgcccaggccaccctgtgactagctacgctgagtaacaggtcccatgtgtcacgtgccactgaacgcagagatcggcaggtaaatcacgaacggcctcacgacttacctgtgtgccaagttcagtaattgagcacccttgctgactgccgaggccctggcgattcaactgaatcgtccgcgcaccaactcgatacaagtcactcatgatctggtggtaggctgcggccaagtcatgcaccatttccgtatctgattgatagactcgattaagtgcgcgcgcattatcggaccgtttgagttctgccaagcacagctcgggagcgggcaagatttgtttatccacagttccaccactgatttgattgcgcatgaattcaaaatgcgcaacggcaggatggttgaagccactgattttaccggtcaacgcgagcgccggcaccaaacctatcccggattgggtgatgccttgtagcccccagaaaaagttaaagtgccaccaatttagattatgcgacttatcaaccggtttccgaatatgatgcataaaagcagcgtcctccatccgtttaagtcccgccgcgttaatattcaacgttgttgtgccccgatgcaaccctttttgagaccgcattgccatttgccaaccatgtacacggtgcctaaccatcatcatcaatgtgccaaattccatgcccgtttagcctccaaattaattgcattctgccaatataaaaatcgtcccctactgcttaaaaaggacgatttcaacgtttgggtcagcctttaactgccaacaccaaccattattcttttatgacgaatttaagtaatgtttccagcatagaatggtgctcaccgaatgtcaagcgctaatcgtgggacgctgtcatccccttaacgccaatatcagttcggtacactagatcaccgactctgagttggtcgatttgttgataaacagcccgctgtgctgcgaccaagctcggggcacttgcggtaaccatcatcacccggccacccgcactgactaattgatccggggtacccgcaacgctagcataatccgcaccagcaaccgtcggaaccggtacaccggcttcagttggtcccggataaccgggagcagctagtacgacgccaagataagttgccgtcgtttgccactgcgcgtgtggttgccgatgttgcagtaagtcgacgatgacttgataaaaatcactctgtagttgtggtaataagatctgcgtttcaggatcacccagtcgcaaattatattcaataacttgaacaccggtcgcagtcaggattcccccaacatagatgaccccttcaaagcttaacccatcggttttgagacctgcaatcgtcggttcaataattgtcgcaatcgtttgatcgataaccgcgggcgtgatttgcggtactggtgaataggcccccataccacccgtgttcggtccccggtcatggtcctgtaaccgtttatgatcttgggcggtcggtaataacgcatagtgctcaccaccaaccaaaaccatttgggaaaactcaaagccagcaatgtagtcctcgatcaagaccgtcgaactagttttaaaggccgtcttaatcgctgccgcggcttgttcataactcgtcgcaaccgtcacccctttaccagctgccagcccatcgactttgataacttgcggcaccgcttgttcatgactataagctagtgccgaatccaattcatgaaattgccggtagtcggccgtcggaatgtgatggcgactcatgaaggccttcgcaaataccttagaactttccaactgtgccgcagcttggttggggccaaagatagccaggccggctgcttgaaagtaatcaacaatgcccgcggctagcggtacttcgggtccgacgaaggtcagggtaaccgtattggcccgtgcaaagttgaccaaccccgcaaagtccatttcgtcaatcgctagtgtccgaataccatcccggatcatgcctggattaccgggtgcacaatagacggtactgacttgcggacttgccatcattgccttggcaatggcatgttcgcgaccgccaccaccaactactaatacgtttgccatgcacgcacccatcctttcattaatgccggaagtgtcgaacaccagtagtgaccatcgcgataccataacggtcggccatggcaatcgaatccttatcacgaatactaccacctggttgcacgattgcacgaatgccgtgctgcgcagcatattcgacgcaatcatccattgggaagaacgcatccgaagctaggatagcattttcgtagccagcttgttgcatcgccttaccgatggcaatcttagttgaatcgattcgattcatctgaccagaaccgattcccaatgtccgatctgcggtagttacaacgaccgcattgctcttaacgtgcttcacaacttgttggccgaaagcgagtgcttttagctgcgcaggtgtcggttgggttacggtaactacggtaaaatcagctggcgtttcgaaggccgcgtcgacctcctgacgtagtaagcccccaccgactgaaatcgtttcaaacttatcggccgtgtgcgtttgctcaaagtcaaccgtcatcaagcgcagattcttcttcttggccaaaatagcaaaggcatcgtcatcaaaactcggggcaataataatttccaagaagagtgcgtgcatcttctcagccgttgcgagatcgactgggcgatttaaggcaatgattcccccaaagattgaaatcgaatcggcttcataggctttatcccaagcagcctcaatcgtcgtacccaagccaaccccacacggattcatgtgcttcattgcaactacggccggctgttgatattcactgaccatccgcaaggcggcatccgcatccttgatgttattgtaagaaagctctttcccatgaatttgcttggcacccgtaatcgagaagtgcgtcggtaaggcattttcgtaaaaggcagccttttgatggctgttctcaccataacgcagggcctgcttcttatcataagtaagggtcaacttttctggaaattcttcagtcgttaaatattgggcaatcaaggcatcataggccgcagtatgttgaaaaactttggccgctaaccgttgacggagtgacggtgtgaccgcgtccgtctgcaaatcagccagaatctgctcataatcagcaggatcaacaattggcagcaccgcggcaaagttcttagctgcggaacgcagcatcgacggaccaccaatatcgatttgttcaatagcttcagcttgtgtgacgtctggttgttgaatggtcgctttgaatgggtacaggttaaccacgaccatgtcaatcggttgaataccagcttcttttaattgcgccatgtgcgctggcaggtcacgtcgtgctaatagtccggcgtgaaccttaggatggagcgttttgacccgaccgtcaagcatttcaggaaaaccggtcacttcttcgattccgatgactggaatatcagctgcttccagtgcctttttggtcccacccgttgaaatcaattcatagtcaagggcaacgaggcccttcgcaaaatcagttaatccctgtttatcagaaacacttaacaacgcacgttttgtcatcttaaattgctccttcattaatgagtgtctgtaatacatctggataaaattggtgttcacaatcatgaatccgggtcgccaggctggctagcgtatcgtctggtgcaaccggaacgacccgctgggcaataatttgcccggtatcgattccggcatcgatatagtgaatggtaacgcccgtctcagtcacaccagcggcaaaagcatcctcgatgccgtgacgaccaggaaactttggtaacaatgctgggtgaatattgatgattttatgagcatacgaattcaagagggtcggaccaataatgcgcatgtacccggccaataataccagttcaatttgccgtgcttgcaaggccgtcaaaatgattgcttccgcggccgctttattcgcataatcatgaaaatcaacaattaatatcggtacgttagctgcccgggccttgtcaattaccggcgctgtcggttgatcacacacaagtaacccaatcactaccggtaattgtcgttcaataatcgcttggtggagtgcaacaaagttggtgccattacccgaagcaaatactgcaattttattaggcatgctcagcctcctcaaaaacgacgggtgtcgtatcagtttggactgttccaactcgataataggactgagcgttggccgtcaaattagccgtcacagctgccacttggtcggggtgaacgatcagaaccattcccaagcccaggttaaaggtcgaccgaagatccgtagcagtcagccccccgagttcggccagtaacgtcataattggcggtaccggccattgacccaattcaaggtgcgcactcaagcccgccggtaacgctctggcgacgttctcaatcaagccgcccccggtaatgtgggcgatactcgtcactaatttctgctgtaacaatggttgaactgcatcaacgtaaatggtcgttggtcgtaaaatttccgtttgtaaatcatgaccaagttcgtcaaaaaccgtggtcaattggtagtcgtgttgtttgaataaaatatcacgaactagactaaacccattcgagtggaggccattagacggcaacccaatcaagacgtccccagcccgaacatttgctggtgataacaggtccgcgcggttcgcaattccgaccgcaaaaccagcgaggtcgtaatggtcctgaccatacatatcgggcatctccgcagtctcgccaccaatcaacgctgtatgggcctgctgacagcccgtgacgacgccagtcaaaatggctttgacccgcttctgatccgtatgtccaagacctaagtaatctaaaaagaactggggggtcgcgccttgtgccaaaatatcattcacacacattgcgaccaagtcaattccaatcgtggtatgttgatcagcagcgattgcgactaagagcttagtccccacaccatccgtccccgctactaacacgggatcgttggcagttgcatccggactaagtggaaacgcccccccaaacgcgcctaattgctgattgccactcatttgtttgaccgtctttaagacgtcgtaaccagcgttgatatcaacgccagcccgcttatacgcatcgctcacttgatcaccccttcatgattggcttgtaattgcgcaatttccgcatcatactcggcttggtaatcatacagggccgttggataatccccattaaaataggccatgcatagtccaccatacggttcggtggtcgacaagccaactgcatcaacgacgccctgttcactgagaaaaccaagtgagtccgcaccaaacgtctgacacatctcccgaatcgtttgctgagccgcaatcaattcattagtcgattgaatatcgataccgtaaaaacatggatagcgtaatggtggcgatgcaattcgtaaatgaactgactttgcacccgcatctttcaataatttgacgatccgccgactggtggtaccacgtacaatcgaatcatcgattaagacgactcgtttaccagcgacaacacctttgaccgctgaaagcttcatccgaaccccctgttctcgcaatgcttgggtcggctgaataaaggtccgtgacgaatattgatttttaattaatcccatctcgtaaggcaggccactcgcttccgcatagccggtcgccgctgataaagatgaattgggtaccccgacaacaatgtcggcgtccacgggctgttcaacagcgagctgagcacccattcgtttacgtgcagaatggacgttgacgccgtgaatatcagaatctggacgtgcaaagtagataaactccattgaacaaatcgccaactgtgtatcagtcgtataatggtcgatcgtcaaaccatgatcatcgatcgttaacaattctcccggctgaacatcttgaacaaacgtcgcaccaatcgtatcaagcgcgcaagtttcactacaaacgacgtacccgcccgtgggtaactgaccgacgactaatggtcgtaacccgttaggatccaaagcggcaatcaaacaatcattcgttagtagtaagtaagcaaagcctccgtggacttgacgtaaagcatccttaacctgttccgttaacgttgctgcggggctgcgtcgaatcagatgcattaaaatctcactatcagaactagcatgaaaaatggcaccatgctgttccaaccgtcgccgcagtgtcaccgcgttcgtcaaattgccgttatgtgcgagtgcaaactgtgagtcgctaaaattaaaactcaagggttgaatgttttccaatccatgattaccagccgtggcataacgtacatggccgactgcagcttgacccgtcaaacgtgccaaccgccgtgggtcccgaaagacatcagccaacaaccctagtccacgttccgtctgcagtttgccgtgatcattcgccgtgataccggctccttcttgcccccggtgttgtaacgcatggagcccaaagtacgttaattgggcggcgtccggcgagccccaaaccccaaagacgccacattcttcattcagacttcttacttcagtaggcatggtaaggccccttcccacaactgtttggcgaaactaaccttaatatcaaacgcctgatcagcagtttgaacgtgtagccgatccgttgcagttgttcgtcctaaataggtcacatatggttccattaaactttcaaacgcggcttgctgtgctggtgtcaccgagataacaaatcgtgactgcgtttccgcaaagaagttggcagcgggcaagtcactggccagttccaccccgatattttgtggaaaacatgattcggcaatcgtcgtaatcaagccaccttcagaaacgtcgtgggcactagcaactagtcctttttgaatcgcagttaacaatagacgctgattacgattttcagtcacaaggtcaaaatcaaacagctcgccactgattgttcccgtcaacatcttttgcagctcactaccattgaaatcggcttctgtggtacctaacacgtagactgcatcgccagcgtgtttaaaatcgctagtcgtaatatctttctgatgcttaattaacccgaccatcccaatcattggggtgggatagatggcttccccgttcgattcattgttcaacgagacattgccagaaatcacgggcgtattgaataattggcaggcacgagcgatgcccatcgccgattcgtccaaatcgtaaaattgttcaggtttctctggattaccatagttcaagcaatcagtgatgcctaaaggttgcccaccggaagcgacaatgtttcgagcagcttccgcaacggcgatttccccaccgacacgggggtttaagtataagtatcgcccgttaacatcggtggtgaccgccaacgccttatccgtatgtcgaatccgtatgacccccgcatcggaacccggcttgatgaccgtattcgtttggacctgcgagtcatacgttccatataacgacgctttggaagcaatcgttggctgttggagcatcttcttcaatgtgccagttgcatcaactagtcgtggcataaattgatgatggctctgatggttcaagcgcgttggtcgtttcttttcgcgttcatagaccggcgctttggtcgcaagtgcatcgacgggaacatctgcaactaacttaccatgatggaataattgatactggtggccggctgtcactttaccaattgtgacagcatcaagaccgtacttttcaaagacttgataaatttctgcttcggcaccagctttgacacatagtaacatccgctcctgtgattcagagagcatcagttcaaacggcgtcatgccagtttcacgttgtggtaccaagtcaagattcagtgacaacccactgcctgctttggacgccatttcggctgaggaggaaactaggcccgccgcgcccatatcttgaatcccgattaaaacatcacgatgttcatgaataacctcgagacacgcctccatcaataatttttccataaagggatcaccaacttgaaccgcggaacgctgggtttcattggcgtcattaaattcagcagaggcaaaggacgcaccgttaatgccgtcacgccccgtttttgcgccgacataaataacggcgttgccaattcctgttgcttggcccttctgaatatcagcttgatccaagattccaacacacatggcgttcaccaacgggttcttctgataactcgcatcaaataccgtatcaccaccgattgtcggaattccaatacagttgccataaccgccaatgccggcgactacttgcgaaatcaagtatttcgtatgagcatcagtcggttccccaaagcgaagactgtccagcagcgcaatcggccgggcccccatcgaaaagatgtcccgaatgataccacccacacccgttgccgcaccctcataaggttcaactgcagacggatgattatgactttcagctttaaagaccacggcctgaccatcaccgatgtcgataataccggcgccttcaccaggcccttcaagtacctgttcaccctgcgtccaaaattttttcaagactggttttgaattcttgtaggagcaatgttcgctccacatgccggaaaacaacccggtttcagtctcgttaggtaagcgttgaaggaccttatccgttaataattgatactcagcatcggttaagccccaatcccgatagaccttagaatcgcgaacatctgtaggtgataatggttgctttttaagcatgggtgacctcctcttgactcgcaatgaccgattgaaaaattccgagaccgtccgtggaacctaagatcatctccacggcccgttccggatggggcatcatcccaagcacatttcccgcttcatttgtaatgccagcaatattagccgtgctgccatttggattctcgacgtattcgaagatgatttgatgattagcacgtaattgcgccaaggtggcctcatcacaataataattgccttcgccgtgggcaatcggtaaactaatttgatctgtcgatccgtatgcggtggtaaaaatcgtctcatgattggcaattcgtaatgggctgtcctgacaaataaacttcgctgagcgattggcctgcaatgcaccaggtaataatccggcttcggtcaagacttgaaagccattgcagattccgatgactggtttaccagcgttagcaaatgcaataacggccggcatgatgggcgcaaagcgggcaatcgcaccactccgtaaataatcaccgtacgaaaagccaccaggtaacaccaccgcgtcataacctgctaatgaggtcgctgtcgccggaatcaaatcagccgtaacgtgtaaaatatcgcgcaaggcattcaccatgtcatgatcacaattagaaccaggaaagactggtacggcaaatttcatcattacaaagcctccatctcagtaatttcgtaacgataagtttccatattaacgttggctaacaagcgatcacacatctcgtcgatttcagcggcaactggccgatcatccgcgtgaattttcacctcaaaatacttacctaattcaacggcatcgacattcgtatatccaagtcggtgtaaggcatcatgaatcgcctcacccttggggtctagaattgattgcttataagtcacatagattttaactaagtacatgttaggcctcctcaacggttgctagccgcgtcaatacttcctgataaacactagtcaagtcgcctagatccttgcggaagacatccttatcaagcgatgcaccggtctttaggtcgactaaccgacaactatctggtgagatttcatcagccagcaagactttaccggtggtcgtcaacccaaattcgattttaaaatcaacgagctgtacccccatcgccgcaaaaattgccgtcaaacgctggttaacctgtaaggcctgccgtttaatttccgccacgattgccggtgttgcaacatttagcgcgtggatttgtgaatcattgataaatggatcatccagctgatcactcttatagaaaaattccagtactggttctgcaaatttagttaagtgtggcacggcaaatttacgctcaaaactacccgaagccgcattccgaacaactgtctccaagggaatcatggtcacgcgacggacaagttgcacatagtctgaaggttgctcaataaaatggttggcaatgccgtgattggctaagtctttgaaaatcaaactcgcgatgcgattattcaatcggcctttctggtcaatgggaaccttccgcttaccatttagcgctgttgcttgatctaagtattcgacccatagaatttcaggatcattagtggcatacatcgctttcgctttacccgtgtaaagcaaagcttgtttctcaatcgctgacgtcattattattgttcccctttcaaatttgccaccgacgctaatgctgcgtcaatatcgtgatttaatacggtgacatgacccatcttgcgctggggcttaatggccgccttaccgtagtcgtgaaaatgccattctgggtgttcaaccaactgttgacgtgccactgttaagtcatcacctagcagattacgcatcactgccggactggtctgcgtaatggccggaatcggtaagccacagatacttcgaatatgggcctcaaactgcgagatgttgcaggcctcaatcgtatagtgaccagaattatgtgggcgtggtgccagttcattgactaataaagtatcatccggtaaaacaaagaattcgattcctagcacgccgcgtagttccagggattcagcaatcgaaaccgcaattttgcgggccgcactatgaacactgggctgaacattagctggggcaatcgttgtgtgtaagatatgatgttgatgctgattttcaactaacggaaaagtcgtaacaacaccagcagcactacgcgtcaccatcatggaaacttctgttcgaaatttctgccgcgcctctagaatgcacggctgtgtcaataaggcgctagcggcttttgtcaccactgctgtgtctagatccgtttgtccgtgaccatcgtagccacctgccgccgttttgagaattgccggcgtaccaacacggttgagggcgtaatttaatgactgtaaatccgtcaccggtgcgaaagatgtgactgggatgccatgatcatgaagaaattgcttctcattaagacgatctccagtaatatgcaggagtgcagtgccctgcggtaactttgcataggcttgcgcagcaatcaaagcattctcatcaacgttttcaaactcgtaggtcaagacatcactacggcgcgctagatcaagtaaagccgcctgatcatcataagccgcaacaatctgaaaatctgcgacctgggctgccggtgctttgggtgtcgggtcaaggacacctacccgatagcccatcgccttcgcgctaagcgtcatcatctgaccgagttgaccgccaccaacgattccgatcgttgcgggtggtaagagtgcttccttaaaattggcgttcactttgttcagcctcctgacgttgacgagcacgaaattctccaattgcatgttgtacttgtggttcccgtaaaccgataatttgggcggccattagcgcaccattcttagctcccgcatcaccaatcgccatcgtcgccacgggtacgccagctggcatctgtacgattgacaataacgaatcaactccgttcaacgtatgggtcttaatgggcaccccaattaccgggagtagtgtattggcagctagcatcccgggtaaatgggcagcgccccccgcacccgcaataataacttgaattccccgtgacgctgcttcttcaccataggattgtaatgtctggggcattcggtgggccgaaataacgtgacgctcataagagactcccagtgccgttaactgttctgccgctaattgcatggttggccaatcagaaattgaccccataatcaaaccaactttcgccatcatgatccctctttccctgttttcaccattagtttagcaatcaggcgggacgctgtcaacaaatttcttaactttatcaattaattaacgttttaatgttcgtgttaatgaaattgataattagattaatgctacctcaacatgtacgaattacctcactgtttgcaggtttccggtgtctggaaaaagttatcaactgatttcaagcgactattttgataatattattaatattgaaatttccgaacaatccgtcatcatctaaatttcaccataacaaacttactgctaccattatcaacaactatccgttgaaacgggccattaacttttgtcggtgcgcaccaacaattaacagcaatgactgggaatcggcgtaggacgagcaactaagcatgtttatgctaactcagactatttatagcggggctaaactgactgccgctgaacttaaaaacaatcaacaacttaatttgcgaacgctttcctaaaggatcggattgaagtgaccaaaataacgcaaaaaaagtctcaaggaagtgattcctcgagactttttaaggtactaattattttgctgaagcgccggaaacactatcgacatcaggtgcttcaggcttggttggtgcttctggtgcggcttccgtatcggctgaagcgccagagacatcatccaccgctggggcagcatcaggcttcgtttccttcgccttcgatgaagctcctgaaacggcgtccgtcttagcatctggatcaggtgctaacatctggcccgtctgcttcaggtaatacttcacgattggtaagaggtcgagcacaaactcgttgatacctttgtactcacccttatcgtcatgcaaagcttgataatagtgcatcacatacttattagggataccaggtaccggtaacttgaagagatcagtctcaccggttcgtagcatgtgtaccgctcgcttaacaccaggtacggcccgctttggatgacagtcagctagtggattaccggcttgagcaggtgtccgtgaagctaacatcttgtcgccatccatttgatggttatagtataaaaattggttgttggcatcggcatacgtcaattccattggcatcgagttgaggaaccaatttaattgattgacggtcagcacaccccgatcgagcttaacgtagtcgtcaccctcagccgcatgggtcttggcagccgcttgttcgacccaatcagccgcatgcatgttgacgcccttgattgtcgtttcaacttcgcccttagcctcaaggtcttcattcttccaatcatcagcgtgtgcttccgcatccatcgcgttgaccatcttgacaaacttcagaaacttgcctaacgtttcttgtaagaacgagacagtccgagcatccttcagattgttttggtcatcgaaagcctgcttaacttcgccgagcaaaaattcattaccaggcatgaccacagcatcaacacccggtgactctaaaatctggcgtagattcaactgtgcccgcgacgaaccttgatcatagtaagaagcgccaacgatcaatacgggtttccctgacatcgggtgaattttaaacgacaaccattcgatcacgcttttaagtgcagcagtaattgtatgattatgttcaggtgtcgcaataatgaccccgtccgcctgcatgatctttcgtttcaaatattgaacagcttcaccttctgtttgatcatcactctgattaaacattggtacatcttgaatatccaaaatttcaatatcaaccatgtcactaaaatgattagcaataaactttaacagtaaccgattataagacttatcttcaattgaacccgcaattccaactaatttcatcgtcgtcgccctctctataatttttcccaatccatttcacgaacttcttcatacgtcgtcgcgttggcattctttaattttttcgtgatttcgacaaagacttggaaatccttgaacaacccatcgagcttcgtcgctttctgttggtccgttaaattcccctggtcatcaaaggcttgcaatgaatgaccaagcataaattctgaacttggcatgatccgcgcccgtaattctggtgaatccaaaacttgccgcagatgtgcttgagcccgtgatgtgccgagtgccccgtatgaggccccaataatcatgacgggtttgtccacgaagggctggatatggaatgataaccattcgagagcattcagtaatgccgcgggagccgaatgatcatactctggtgtactaataatcacaccatcagcttgttcgatcttatccgccattgcttgcgcctgtgccggaatttcatgattttcgggcttattgaagattggtagacccttgatttccattaattcaatctctgcttgatccgcatagtgggactgcatatattgcaacaacttacggttggtcgactcatctgaattagttccaaccatcgcgataaatttgtgcattgagaacaactccttctatgatcaaatagtcaaatattatataatttcttagtcaataactatattgtagtggatttcactaaagaaagcaaaacaattttaagcgctttcagttttactatgcaaacaactgaactcactgatattaggcttatccgtgcaatcaagtaaattcagtatccgcgcaacgttgccgcaattatatctgcttaacaaattttttcacaaagctacgacgctacgatcaaatcaatcaaatccgccggggcaattcgaccaaagtaacgggttaagtccaacggtgctagcgccgtcataatcgcctgccgttcatatttcacaccagtcaaccgtgcaacgacgggagcaatcggttctgcaccgaagaaatcgccataaatcgtaactgcttcgatgcgccctgccaccacgtttaactgaaactcgacggtcccagcatcaaaatgccggcgctgcttaactgtaaacgctggtgactgaccgtaaatccaatcccagttggtaaaatattgttggttcagtgctgctacccctgccagtgccgtttcatctaactgatacgtcttagcttgactcaaatcagccacgcccaggatttcacgggccaacgtatcgcgaaattcctcaatcgtcaagtgctgataagccggcgccatgtacggtttcaagttcgtgactcgacttcggaccgacttgatacccttagaggccaacttatcggtcggcaccgtaagagctttcgcaatttgcgtctggtcgacatcatacatcagcgttccatgggagaacatccggccattctcaacgtgcatggcatttcctgagaacttcttgccatcaatcaataaatcattgcggccactcatcgtcgcaccagtggcccccatcgcgtgtaaagcctttagaactggtgctgtgaaccgcttaaagttaccaaaaccgtccccgtcgtccttagtaataaaactaaaactgacatttccaaggtcatcataaaccgctccaccaccagaagttcgccgcgtcaatgtaatgtggtgtgcgtcaacatagtcctggttaatctctgccttgacattttggtaacggccaacaatgatgcagggggcgttaatgtaaaagtatagaatcggttccgtcaaatcggcatgttccatcaagtaagtctcaatggcaagattcgtgcgaatatcatggctggagcttgcaagatagcgcatcgtcacacttcctattctaaataaatccgttgcaaatcattgatttcattgttagttaatttaagctcagtgtgtaaatagtggtttaaattacccgattgtcgtttaatttcggtcatagcggcgtccaaataagccgcatcaactgaccagagggcccgaatactttcgaccgttgcatctgatgcgccctgagcacgtgcttcggccatcgcaccattgatccggccaatcgaagcctgattagttaagagataatcctgcttgatcgtttcaaaatcgactccgagtgcggttaacaggtataccgcccccattccggtccgatcttttcccgcagtgcagtgaaatagtaacgtcgaatcgggttgatcatttgcaagtagattatcaaagaaccggcgatactcgtccttggcatgttgctcgtcggccaccatctgatagacctttagcatgtgcttgaatccactatctggatgcttctccaagttagccgtcatcttgtcagtaccgtcagaattccgcgtttcgtccacattgaacactggtgcgtacacgtacttagcattggcaggaattcgatctggcgcatctaagacttcttgtggtgaacgaaagtcaatatcgtagcggacgccataatcatccagcaaagcttggccggctggcgttaattgatcaagtccaccagtccgaatgaccttatgccacttgatttttcgaccgtctttagtcgagtaaccaccgagttcacggaaattaatgccacctggtacagttaatacacgttgatttgtcatttttgaaaccacctatctgttaacttttcattttctattctaacattatcggtcagtttaacggtgccccaatcaccgaatcagtcgctttatttccaagataattcgttagcaccatcgacaccaaccgacatcaacgcgtgctataatgtaagttacatagccagcgacggcccgtcgaatccagaacacgtttgctgacaaacagcatcacaaccttggaccgattagccataaatttccatactggcactaaataaaaaatattcactgaataatataacggaggatctttcgatgacatttgattatgcacaccaaactgattggcccatgactagtggtcaacatcagtcaccaatcgatattcaaacacaacacgttcagtcttcacagctatccgccatcagctggcgaggcttgtaccaagccaaaacgattacgggcgaagcgacaactttgaaggctagtggaattggtgccgcttatttgaacgaccgcgactttgcctttcaacagattcactttcatacgccggcagaacacttaatcgatgggcaagccgcaccaatcgaatggcatctcgttcatcaaagtgctaccggccagctcgccgtcgtcgccgtttttggacggattggcaagcctaattctagtttacaaggcttacttgaccagttcacagcccaaacgagccatgaactgacaacaccggtcaacttaactgagctcctcccagataccgggacggtctatcactacttgggctcattgacgacgccgccactaagtgaaaccgttgaatggtatgtctgtgccgatactgtcatgattggtgaacaacaattagctgcttatcagcaattatttgccgctaataaccgcaagattcaaccgttaaacgatcggccaatcattgccgaacgtttctaaataattttaatggggtgagctgatgcctaagaaagtaatctggggcttgattgcaagtggcctatttcttttattgatcgtcggtctcggactgacaacacaaatccatcaagataaagtcagtcacgtgattactgcgcaaaaacggccattgatcatgattggaggtagtagcagcacgcggactgactttgatgacatcgtccgttcacttaatgagcaacagcaccatccgctcatcaccctgactgttaaggcgaaccaaaaattggcgtttaaagaaaaacgcgtcgagaacaccaaccttaacgatgccctcatcgtgatctttttcgaagatagcacggactcaacagagaacattatgacccaaacgaacggcttagccaaagctattcgttatttgcaacgtcaccaacatctcaccacggccaacgcactcggttattcaaatggtggcctgatctggagtcgctatctagcaggtttgagctcgtccaaaccattagcagtccacgatttgatgttgattggcaccccattcttgggtactgatgctgcacatcctgataaaacgctctatacaccacttcttgatcacaagaaccaattcaagaaattgcatgcggtcatcaacattgccggtgacactggcgagggtaacgacgatatcgtaccgctcagcagtgtgaacgctggtggcaacttatttatgaacaatgttacccgctataccgccatgactgttaaccaaaaatcaattagtcacggtgacctgcttcacgaagcatatgttgcccggctcattcgtcaaaatctgatcaatcaatagtatctttaactttagctgataaaaaactgagccacccttcatgatgatgaagggatggctcagtttttttatgattgattgtccgctatgactactggcgatcaaactatccaacaatttagtgtcacgagtagcccacacacgggttgcacagggctcaaaggggcgccacgtcgattatgaattggcagtcgctacaaatcgagctagctcatcggtcgacataccggcactgacacccaccagtaacttaatccgggctttttgtccattcaatccctgacaaaaaatcacacccatttgtttcaattgaacaccgccaccttcataagcatagacatcctgagcgataccgttgaagcaccgggaaaccagtacaaccggaatctgcatgtctaataatttttgcacagctggtaacgtcgccggtggcaaattccccgctcccaatgcttcaatgactacgccatgagtcgtgggttgtgcaatggcgtcaaatagttctggtcccatcccggcatatgctttgatcagaaaaacattatccgtgaccgtttgaatcgggcaaaccgttgaccgtagtaatgattcaaaaaagacaatgcctttattagcgactaacccaatcgggccaaaagtcggtgttctaaaagtggccacgttggtcgtatgcgtcttagtgacgtagcgggccgagtggatttcatcattcataaccactaaaacacctttttcggccgcatccggtgtactagccgtttgaatcgccgtttcgagattatgcagaccatccgacccaatctcattggcggaccgcattgcgccggtaatcacaacggggagctcattcggtaaagtaagatctagaaaatacgccgtttcttctagcgtatccgtaccgtgagtcacaaccaccccatcgaccccttcgtgtgcggccttatcgatccgttgctttaactgcaacatccgtgccggggtgatgtgcggcgacggcacgttaaagacgtcctcagtctctaactcaatatccgtgccaaatgaactctgataattgtctaaaggattttcatctccgggggtcacattgccggattcatcggccgacatcgcaatggtgccaccagtgtgtaataccaaaatcttcttcaagaatactcctcctcatcttttcacgtgcctacgcacatctaacagtaaaattattttaggcttgccatcgcctaattgcaatccaccctcactggttcttcatgacaacttccttagattctcatacaagtgatatcaactaaaaaaactagcaaccattcaaacaatttacaaaacctagcaaccagatcagtacgttttattagcctacatagtgctagtcactcggttagttcacttatcaactagttcgttaatcggttcgtcggttagttaccccttcaggacgaagtcactaacctcagtgcaccttattactcaatttcagtctcggggctaaccgattggccactcgctagacgttgataaatcagcgtttgacgtcccaatgactatcaagcgagaaaataatgattgacactcgcgttagttgcctttatagttagttacataagtaattaaccaaataacaaaccaactaacttaagagaagtatttaaaatgacaaccacaccaatcatgaccgtcagcgacctgcacaaaacgtatggtaaggcgggcagcaaacaatacgaagcgttaaaaggcattaatttcaatgtgcaaccaggggaatttgtcggaatcatgggcgcatctggttcagggaaaaccaccttgctcaatatgctggccacactggaccaaccaactagcggtgaagtaacgattcatcaacaaccgattacacatctgaaaggcaatcaacttgctgatttccgggccaaagagattgggtttatcttccaagatttaaacttattagaaactatgactgcttacgagaatatcgccctaccattgtcgctgcaaaatacgccagtcaaaaagatcaagccagctgtcgaaaaagtcgcacaccaattgggaattgaagaattcctatcaaactatcctaatgaattatctggtggtcaaaagcaacgtgtggcagccgcacgagccttaatcaatgaccccgctattctatttggtgatgaaccaactggtgcccttgattctaagtcagcgcgtgaattactcgacctgttcaccaaaatcaaccaagaacgggctgtctctatcttgctggtgacccatgacccattttcagctagcttctgtcaacgaatcttattcatcaaagatggccggattgggcaagaacttaaacgtggggatttaagccgcagtgatttttatcaacaagtcctcgacaacctagggacgtttgaacagtaagccgaaacagtaaaaggagtcctttaaactatgttaactaaacttgccatgaccggcttcaaacaccgttggcgcgactacctcgttctcttttcaggactgatcatgtctagcgcaatcttctatatgtttgaagcactggccactaaccaagatttcttaaaacaaaatacgagtattagtatggtcggcctcatcttccaatttggttccgtactactcacaatcatcacattagtctacattggctatgctaactcattcttattaagtatgcgtaagcgagactacgggctcttcatgctcgttggtgcacgcaaaagtaagattggtcaattaatttggctggaaacactacttgtcggtatcactgcaaccattgtcggcattcttgtgggaacagccttaactgtcggtgtaagccagattctgattaacagtctaggcctgacgcttcaccattttgcagcctggtacacgccagctgccattgcgacactgttactctacgttggattgttcttaattgccggtttattcaacctgctatccctgaccaagacaccagccttgaaattactacacagtaatgatcaacctaaccggccacaactaaaaccagcccgtcaactcatcgaaattgtcgtcggtgtcatttcaattgcaattggttactggtcaatggctaacctgaaaattttgcaactgatgggaattggaattgcgctcgtcacaattgttcttggaacttatctgctgtttaacgctatttttgtctggttaatggtcgcactcaaacgattctcatttgcccaacgtggtttgaatggcttcaccttatcacagctaagctttagaattcgtaattacactaagatgctgtcaattgtcgcaatgctattcgcactagctctcggcgcaattacagttggaatgggctttcacagtcaaattccatcaatggctaatattaataacgcttatgatatgggactggtcaacgctagtaccgctgaaaaagcacaaattgcagcgatgaagcccaagacaacggcgacctatcatttcaaagcaaccaagaaagtcgtttatttccaagctgctgaattcaatcggcaaccattcacgactattcatactcgcaataagaatcaactgacttttaataccgttcataataatgcggctaaattacaaaaatcagaagataattatcaactgatgcagcttcagagtggtgtcatggcaaccgcaacacccgtatttttatcaaaaacggcgtacgcgaaacttgcccagcctgaacagcgactaactgtgtttactaccaacaacgttatcgaacatcgcgttgcattgaacaaactggccaaacatcactttcacactaccagccctgaacaatttggaggtcgctatgcgatgtatctaatggttaacggcatgtactccgggctggaatttatgggtatgttcctcggaatcgcctttcttgcaatgctagctagttgcctgatgttcaagattctgtctggtgccgatgctgatcaacaccgttacaagatgctcgataaagttggaaccactagacgccagctcaacggtgccattaacaaagaaattgctgtgctctttattcttcctggaatcgttggtattgtacacgtcttgtttgggttacaaatgttcaaaatcataatggttacctcaccatataccggaatttggttaccattcttgatttttgccggtctctacctactttactatctcattacgatcaccatctatcggcgaatcgttttacaataacctttcggaggagggaaaaatcatggtatactttggattagtcgctttattaatcgttattacaccattacaccgttacgtgctcgcaagtcgtcgtcaattctggttaggggcgctcatgccgcttctgtggctgagcgttaacttcggtttagccacccagattatctttgaacatcaagacattctactggccgtactgggcaccctcctcctactctctagttggattgctgcccggatcgatcgtaccgaacgacaactgcaccagccgcaacaaaaggccacaacgaaatagggcaatcactgcaatgaggtgaataaaatgcagttcaactttaatagcacggaaccaatctacttgcaggttgccgaccaaattgaagaagctatctttacggaaaccttcgctgaaggtgaacaaattccttcgacaaccgagatttctaaagaatttcatattaatcctgcgaccgtgcttaagggcatgaatattctagttgatgcccaactgattgaaaaacggcgtggggtcgggatgtttgtcatcgccggtgcacaacaacgaatcgttgaaaagcgccgggatcagttctacaccgactacgttaaaaaactagtcgctgaagcacaaaagctccacattacgcaagatgaattagctaaattaattgaacgggggttttccgaatcatgagtattcaagttcaggctgtccagcaggcctttcgcggtcaaaccgtcctggataatcttaacctaacgatcaaaccaaacacgatttacggtttgctaggccgcaatggtgctggtaaaagtaccttgctgaacattatcagcaatcgtatctttgctgacagcggaacggtcaccatggacaacgaatccatgtgtgataacgaccgcacgttaggaaaggtttacttgatgagtgaagttaacctctattctgagcgttcccgggtcaaacaactgtttaaaaccaccgcactactctatggtgattttaatgacacttatgctaaaaaactagcacaaacctttggcctcgatttaaacgcgcgatttggcaaattatcgacgggttaccgaacaatttttaaactgattattgcgttatgtgtaccggctgaatacatctttttagatgaaccagtcctcggtctggatgctaatcaccgcgaaattttctatcaagaactgattgaaacctatagtgaccatccccgcacattcgtgatttcgactcatctcattgaagaaattacgaacttgattgaacatgtctttgtgctggaccatcatcatattattgttgatggtgatgtcaccgacatcctagggcaatcttacgcggtaactggtccacaaactgatgtcagcacttatacggatggtttaaatattatcggcaaggatcatcttggcggaattacggcccactacgtttacgggccattagataacgaccgaccaattcctgatacggtcacggtcgagcatctggacctacaaaaactatttgttaacctgactaataccaaggaggaggccgccgctcatgtcaattaaggttcgcaacaccacccgttatttattaacggaacaattgaaaatgacggggtggtcggtactcgctttattcgtcgtattcggaatactaccgctactatttgcagttattacgggtaatattcggcagtattctccacttggtaattttgctagcctaagcctcgggccactcttcttcatgcttatctttattgtggggtcactcacttacgacaactttaagctcttaatccaaaatgggatttcccgacaaacctactttcaagctcgagtattcgcattactcatgcttagtggtttgcttgtcatcatcaatgccatttattactacggtattcatgctccgtatttacactggagcaccaacaccgcgttgatgagaacgggctattcgctgtatagccatgcgctgggaaatcaggtctggctaaacattttagctagcttatgctttaactggattttctacattggcgttggccttaccggcatcgcttgtgggaccttactcgcgttatttggtaaatgggccaaaacgattttaatcattggcactcccatcattggcatgcttattatttggataatggtcatcattatgactcgcaatcaatcgaactataattacacggggcttgaaaacttcttgaaatttattattggttatcccagccacggtgaagcgacaactggttactttaacccaaccatgccattcatcacaatgctggtaggttgcggtatcatcggtggtctcgcctatctgttcaaccgtaagttaagaatcagaaattaagctgataatctaaaaaatgaagcaggtcgtgaagttattgacttcacgacctgcttcattttttaatggttaatacaaacgtcacaccattcgagaagtggttttcccactaacgctacttttcaacctgcgtattttgcaaatccgtcttaaccacgattacatcagtcaacgcattacgctgcacatacgttgtaaccgagccttccagcacgcgttcaacggcatttaacccggttgcccccatcatgatcaagtcattatgatgatccttgacgaagtcctgtgaaataattggtttcggacttcccattcgaatgtggaaggcaatgtccgtaaagccatcctttttgacttgatcaaccgtttcttttaaataagcttcagaatcctgaaccaattgatacgtaatatcaccatccgccaaaccagctaaattatacccaaactgaccgggatcaatgactgctaacacgtcgatatgtgcctcattacgtttagcgactgcaactgctttatcaagcgcaatctcagcttgttgtgagccatcgaggggaactaaaatattcgaatattcttgtaccattgacgtcacgccctttccatctgttaattctattttaccatttatcagcgttggttgcgttatcatttatataaactaactaccagttatgcacagcagctcgccggctagcagtgtcgggtttacataatatttacaacaacgacatctgatatttacagttaccccttacaattggagttaatccacttgggggtgaatagtatgctttctttaggtattcgaccaggcctaatcgccagccatacaattgtaatcaacgatgccctttcatatcaaatccggttaagcaaattgcgtctcggacccgatgtctatcggctagacatccgtgcaaccactacactgggccgcttgaccgtgtcccacgcacattaccataactttgccacggcccagcaagcctttaatcatcagcgccaccaacttgaatcgcactaaaaatatccaacacgcagccatttaattatgataggatggtacctagtaataatcagctaaagtgagggtattcatctgtgggacaacttatcaaacaactctggcaacgctatcaaagcgtcctttcctatttaatctttgggggcttaaccaccctaattaatattattgtttttggaattttcaaccaattctggccctactggatagccaatacgattgcctggctcatctcagtgctattcgcctatatcacgaataaaatttgggtatttgactcacaaacacctactttccgtgctgttttaattgaaatgacatcattcttcggattccgcctactcagttactttattgaccaggggattatgattgtcggtatttcggttctgcacggaaacaaccttatcgtcaaattaattgatcaaattattgtggtattactcaattggttcttcagtaaactatttattttcaaggaccgtggtcattaaagcgaaccaacttaaacatcaaaacaagcgtcgtaggaatgtccgaaaattcctgcgacgcttattttattcataataattaccgacccatctttttttctgatacttaacttagctactattttagcaaccatatttttcacccaaactggcgttgcaccgtatgtaacgtcgctaactttgtgaccacatcatcaatattgaccccatcccaattataaaaaatatattggcgaccacagcgcatcttaatcaccaaatgacgtgctgatgaagcataaccattgcgaacttcggcctgatccgtcgtcaatgcatagtattgaatgtcatccgtatttaaagctaactctccaattcgtatcatgacttgttgactgacctcagtcggcggtcgaactgacaaacaagtcccatcatggtgctgataccgtaactctaccgcaactaaaccggccgcggttagctgcggtctaaaataaaactccgcgccaatatgcaacgcacttgacggccaaactgcggttagccgaaatttaaaatgccggccatgaaaatcagtcaggatgtcttggtcgtaatctggttgcattaccgtaatatgcccaatcatgacgattcactcccttcacttagttattgataatgtatcacgcttcacaagcatagttgtgtttaaaacccataatcagtcgtttttaccattttttattaaaatagtaattaaattatccttactcatgctaatatttgagttaaccaactttattgatcggaggtcccgttttgatgacatttacaaatcaagaaactgactatcttatgaacctactaaccaaccagttaatggccctactaagccgcgtcacgcgctggcagacgcacagtctgagtcaacaccaatataaccaacaagtacacgaaacgctccaacccgaactgaacatgctcacgcaaatcactgctaaactccagggacaagcccgtgaccaaactcagctaggggccattcaaactggtttgaagaaacttcaagttgccaccacctatcagctaactgccgaccaacttgcacacgctaatgaacgccggctgaatcgccgataccgcgattaacttttacaacatcagcatatttaccaggagattcaaaactatttcgcaatccttaacagaaaattcaaatttcaatcacgagttagctactttttctcggtacaatggttttatcaactcatacaaccacttgactgaaggagggcttccatgttcttaattgtttactgtacgttcgctattgcagtttttttctggatattcggttacgttaaaaccgccgtcatcattggtatactggcactgagcttgattgcttactccttcattcgccaagagattactcgacgacgtttgctcaagcgacgcacggttaccaataaaagtcgttaaaaaaattccaacacgccggtgtcggaattttttggttatttttgcatttgtgataaacaagtgacgatccgctgagccgcctcacgcacattttgcggattagtcgctaagttcaagcgaacaaacccctgatcatcaggactaaaccactcaccaaagtcaactgcgagctgacattgatcttgaataaacgctttcgttgcagctggctgaacgtacgcgcgtaaatctagccacgtcaaatacgtcccctgaaaatcggctaaaaccaacttaggcgcgtgggcggcaaaggtggtgcataaataatgataattatcacggacgattgccaaaatctggtctaaccaggccgcgcccgattcataagccgtttggccggcaacctggcctaagaacgtgtttagaatctttttaagagtattcgcaggaaggctaagctaatcatcatcttactggtgttcagctttcgctcacaattgcgccagaggcgccgatattttcctagccagctaaaactgcgttcgataacccagcgttgcggggtcacttgaccgtgcctaaggtcactctgtttagcaataatgacctcagcgttaatcattgcctgaactgattgagcaaagttgttaccagtataaccaccatcggccattactcgttgaaccaggtcaaactgtgatttgtttaacgccagtagcgcattggcgccatcacgctcagaaacattggcggttgtcacatggactgccatcggcagcccattgatatctacagcaagatggcgcttaatcccactcacctttttaccaccatcgtagccgctactttcagcaggatcggtattcttgacactttgagcatctagaatgatgaacgatgtataaactgaacgcttctgagccaaccgatgttggctgacaatttttttaaaaccttatccagaggagtgataccagcaggagatggcgttttagtccaaagtaaccagtaataatagacggtttcccatttaggaaaatcgctgggtaaatcgcgccaaacgcacccatttttcaaggtataaagcagggcacaaaagatatcatataaatcaacctttcttggcttagtccgcttacgtatgccttctagatctgtccggattagttcaaattgttcacgagagatgtcgctactataatggtgtgcaaagcttttcatggattaaaaactcctgtttttgatctaatttaactaaaatcaaatcgaatgtcaaagtatccaaacacgttctaagacgctgatctcagtctggctgaagcgcccgatttgtgcatcatagcgttgtcgtaattttggattaggaattactagatgtgagttcaaaagcgccgccagattaaacgtcttagacggtgcattgacgacaatcacccggttactaaaccgcccattggctaccgttaacgccgatttgaacggatggttggtccgatcaatttctaaatcctggtgaatttcatctgaaataacaagcacatgatactgttcacataatgctaacagccgtgtctcttcatcttcagaccagatccgccccacaggattatgtggcgaacattgaatgaacaaccgcacctcgttcgctttaatttgctgttccacatcttcaaagtcaatcgtatagtgaccacgatcattgcgtaactcagatgtgaccagctgacgatgattatcccgcaccgcgttgaaaaatggatagtacacgggcgtcagaatcaaaacgccatcacctggttgcgttaaaatattaacgagcgcgtacaacgaattgaccacgccactaccaaatcgaatccaatcgcgtttcaatgtcagaccatggcgtgcctgttcccaatcgataaaggcttgataataacgatcaggcgtaatggaataaccataaatgccatgcgccactcgttcttgtagtgcttgcgtaacttgttctggcactttgaattccatgtcagcgacccacattgccaacaaatcaggattgccataccgagcttgtagtgcgtcccacttcaatgaatccgtatgctggcgcgttattgcgtacttcttaataaatgctgcttgttccatcttaaaggccttctttctcaacaaaaaaacttcgtccttaacttactaaggacgaagtttatactccgcggtaccacctattattacagtcttgctgtcgcttacgcaacgtactcgttacgttcaacccaattatcggtggtcaatccgggctaatagcatcaagcattagccaactccgagttcatcttcacaataagctgatggtcaaattacaccactactttgactcgctaggcaccaacttattgctactcttctcatcaacatttaatcttcacgttgcttctaagttacaacgtgaagattaaaaagtcaacaacgtctttaaaattgcgcttgctctaaaacctggtagccatcgattcgttggtcagcggtaggaaacgccccggtctgtaagaaacgcttggcctgcatgacccgcggcgaactattcgaccaatttaattgatcaagtggcactcgagcggcccccgccgacattgattcggtgtaatgcggtcgtttgagcaacaaatggccccccaccggttccagtaaataataaatattaattaacgttgctggcaattctaatgttgttaaggctggaatcgtaagctggacggtcccaagttgctttgaaataacagtttgtagtcctgtttgaagttgtgcaatctgactaacggcctcactcaacgtggcccgtgtcgtcactggtgcggttactaaatcataacggttcttgaacggcccggttaaggatttattaaggaccatggccgtcgaatcaccaatgataccacaaacaaatagtggactaattgctggttcgttaatcatcaatcttttccttctctcagtcatacgattaaatagataaattaattagcctataaaaatataacagttacattttaccttagaattatgataaggttcctaaaaaaagcatgcgaatatgaatatttaacaacttttaataattctatgaaaaaaaccgaatcttggctactaaaacgcacaaggttcgattactttttttgttatttagttagattgcacatcggtcgtattaataaatgactgggctggcacacgaattaaccaccgcgtcatggcttgatgccccacatggacacctaagccattccagaatgacggctgataagtggctgtcagcttcactgcgtaggctttttcgtgctgccggtcttctttaaccagctgcttttgtgaccacggaataccagcatccgccactttaacttgcgaaagattagtcaccacggtcgccttgttacttgaaacagtatatttcgcaccattaacccagtaattataaatatgcacgggtttttgggtcgtgcctcgatccaccgcgacatagtaggaaccattagttccaactcgcaaaaccagtggttcaacttgatacgttaccttaacgtccttagcatctgacaggtcgacctggtgattgaaagtcacgtatcccatgccaactagtaatccgagactaacgattaattcaacagtggtaatgataagatttccccactcaaacgtatgcttacgttccacgatcatcttgatgcgtcgtacgcgaatatgatgaaatacccacacgactaacgccaaaacaatgatccacgcaatgatcccaatccaattccatgcagaagtcattgattgccaaccctttctcaattacattattatgttctaattgtaaataatccaaccttaaataacaagtaatccagcaaattcaacacaatcattcagaagcagattgtgaaaataatcactgaaacggtgccaatgtaatcgaattcatggtaaaataaagttattaacttgtagaaagaaggagtacacatgatcgcgtcactaatttattgggtcgtcgttgttggcttgattgtttggggtgtttggatggccatcctttccgcatattgggccagccaaaaacaaaacggcaacattttctttattgcaattatgaatacattaggtgccttggccggcctcttagtatggtgggtcttcaacaatcaagactggcagtactactggttatccagcaccgttaagacaaccaacctcttaggcatcgtcctaatctgctacgttgtcttgattgtcatcgaattcatccaaggccggggcatcaagcctgagacagctaaataatgattattttaaacgccaagcaagttgctaggcgttttttattgtcaaatgcggcaacaatcttgctcttcagtgtttgttacggtgataacatttgatttgtcatgctgcatgcttcatcatgattaataaaaaaaacgattctcaaagacattgagaatcgtttttttataagcgactgtcctaatggcggctatcggtcttgaagatttcaactgggaaacacacagaacgctccaccagtcgacttgtgacactacttcacaactaagccacggttaattcaaagcctcccggtgccatctcatttgcggtaatacccgctgttaagattggcgatacgccacttactgttgagactgcctgtgcacctaaattaaagcggccttgaatcgtctgttcaacatccgtccgcgttaagattaagcagtgaccatcaatcgtccatgtcaattggctagttgctaaaaagtcggcctgttgccggcgaaacttgatcaaacgcgtgacaaattgtcgaacttgttgttcttgctcgtctggttgccagttcatgcaccgacgattgtcagggtcggcgccaccggctatggccacttccgttccataataaatacacgggctccccggcaatagcatcagtagcgtgagtgcagatttaaatttagttaactgaccatgcaacgtggtcagtagccgtggcgtatcatgcgtatccaacgcgttgaacatcgcctgttgattaggttgacgatacatcattaattccagattggttttaccaacgtaatcttcaaggttgagttgaccattaaacaacgccagaattggttgtgtcagtggataattcataaccgcgttaaactggccgttaccgactaacgattgactactatgccaagactcacctaataggtacacatcaggtttgattgcccgcaaggcaccacataacgctcgccagaaaccatggtcgacctcatcagcaacatcaaaacgccaagcgtcaatcccgaattgttcgatccaatatttggtcacatcaatcaagtaagcttgtaccgcggggttctgggtgttaactttcggcatcgctgctcccgtcgcaaaggtttcataattaagccgcttcgtcttcggatcacgtcccaccggccagccatgaatatgaaaccaatcaacaaaccgtgactgctcgccatttttaatcacatcttgccactgtggtgactgctcgccaaaatgattaaagacggcgtctaacatcacgcgcataccgcgcgcatgggcgccatcgactagcgcctgaaaatcggctttcgtaccaaagtggggatcgatttcaaaatgatcgatcgtatcatacttatgattagatggtgacgtgaaaatgggacacaagtacaggccattgacccccagtgcagccaaatcatctaaatgcgctgtaattccgggcaaatccccaccataaaatgaatcacggtgaacacgcccagcaccccacggttgaacattagccgggtcattttgccgcacaccatttgcaaaccgttcaggaaagatctggtaccagaccgtctccttaacccatgccggtggcagctccgcatcactgacgtgcatatatggcatgtgaaaatagttgcccactgtttgccagttagtggcaacgtcgtcaaagaagccaccctcaccatagccaaccgtcgcaccggtcgtatccgtgatcagaaaggcatagaccacccggttagtcggtacggtcagcgtcgtctgccagtactggttgccctgcgtcgctaatccgggctgcattatccgccgctctagcgctgttgttccttcttgccataagtaagaatcggcaaacaaaatctccacttgggcaacatcgtcacgcgcagtttgtagtcgtacctgtagttgatgtgcggctaagacggctgtatcttcactttcagggcggtgcctaattccagctagttgcattgtaagatctccttttatgtaaacgattacattattaactagaccatttacgtcaattatcctcatgattttggtgaaaacgtccccgttcgcctcgattttagtgtatcatttagtcaaaatcagttgaaaggacgttatccatgaaaacactttatcgcagtacccgcgaaactgcaagtcacaccatgacgtcatcacaagccgtacttcaaggcctgacgccggatggtggtctctttgtgcccgtaacgctaccgaccgctaattttgacttcaaccagctcgccacgatgagctaccaagaagttgcttacgaggtccttaaactcttcttcacggattataccgctgatgaattacacgcctgcattgacgcggcttatggtgatcagtttgatgacccccaaattgcgccggtcaccaagcatggtcagcagtattaccttgaactttttcatggaccgaccattgcattcaaagacttggcccttcaaatcctaccgcatttgatgacaacggcagttaaaaagaaccatttacaagccgaagtcgttattttagcggccacctcgggcgatactggtaaagctgccatggccgggtttgccaatgttgatcagactcgcatcatcgtcttctatccaaaagatggtgtcagcgcaatccaaaaacagcagatggtgacccaaaccggagccaatactagtgttgttgcgatcaacggtaacttcgatgaggcccaaacaacggttaaaaaactgttaaacgaccaccaattacacgcggaattagccacccaccagttccaattctcaagcgctaattccatcaatattggtcgtttattcccacaagtggcctattatgtctacacctacgctcaacttatcaagcaggggcaaatcaagaacggtgatgagattaactttagtgttccaactgggaactttggggatattttagctggctactatgccaaacaactgggcacgcccattcataaactgatctgtgcttccaatcgcaataacgttctcaccgatttctttaataccgggacttatgataaaaaccgtgaattcttcttgacgagttcaccgtccatggacatcttagtctcaagtaacctggaacggctcctcttctacttgacaggatcagacgccacggcgactgctaaactaatgactgatttgcaaacgaccggccgttatacgattacaccggcaatgcgtgccaacttagctgatttttgggccggcttcgtgactgaaagccaagatcaagctgaaattcatcacctgaaccatgcccatcactacacaatcgatccacatacggccgtggcctcggcggttgccaaacagtatcaagccgcaaccagagatcagcggcccatggtggttgtttcaaccgctagtccgtataaattcccacaggccgtcctaacggcaattactggtgagcttagtgcggtagatggcctagccgcagttgatcagttacatgagttgattcaaacgcccattccagcaacggtcacagccctccgtactgcgcccgtgcgccataagcgggttgcggatgttgatgatatgggaacgaccattaaaacaattttaaatcttaactagaaagtgtgaccaagatgattacgaccattgcgttagacctagataatacgttactaacttctgagaagacgatttctccgcgaactgaagcagttctcaaacagctgcattcggccggcaaacggatcgtactgtgtactgggcgaccaattaaggcgattcaaccatacttacaacaacttgaactcaaccaaccaactgactacgcgattacctttaatggtgggctcgttcagcaaaacacgactggtgacgtccttgctcgtactagtgtgaccaaacaagatttacaacccttatttgagcaagcccagcgcgatcatttctacttagacgtgattgatttgaagcaagtctactccattacggatctaggcaagtcaccgtacgaagaattcttgcaaggcttaatgccatttaagaatgttcgttttgccgacctgcctgctgatgatctattcggtaaagtcgttagtgctggtcaagatgctaaaacagtccaggccaaattaccaagtcaaattaccgatttcttccacgtggtcccatcccggcggactttgttggaattcttaccaccgcatactgataaggccagtggtttgaaacaactcctcggtcactttaatgaagactatgacaacttgatggcctttggggacgaagaaaacgacctaggaatgctaaccgccgccaaagttggcgtagcgatggcgaatgcgattcctgcggtcaaggctgcaaccaccaatgccaccctgagtaatgacgaggacggggtcgccgttttcctagaaaattacttcaactgatcccaaactgaagcctgtaacgggcttcttttttagcacaaccactcaaaatcaaactaacgaggtgtcccatgcaagatccccgcattatcccagcagaattaacgactggcgcttttttcgatattttagcagatgaggaccacagcttaagttatattcaggttagtgaagaagacatgagtcaccagcacatcgatcaccccatgctggatcacgtgcacttcgaaaatgtccggtttacggccagtcaatttgaacggcttgacttgaccgatgctgtctttatcaattgtgacttttctaattgccagtttgaaaaagccagctggctacgcgttcaattcaaagattgtaagctcgtcggtgtcgacttgaacgaggctgccctcaataacgtcgcctttgaccactgtcagctcgacttagccatgctgtgcgacatgcggttcaaaaccgtgacctttgatcactgtcggctgaatggggccagctttatgaacaatcgactaacgaccgtcaagtttaacgaaaccaaccttgaccaagtcgctttcaacgataccgccctcaaaaatattgacctaagtacctgtcaattcgagcgtctcgaacttgatactgccgtagcacgcggtatgatcgtcaatattgatcaggctgcttatttggctgctgctttaaacggcatcaaagttaaaccctgataccggtggaacagtcaccgtatgagtgaccaactcacaatgccaaggacgattaagctgctggctggtaaatcttctaataacactgcacgtatctgtcagaatacttttcacgcgctgaacacaaaaataccacctccgtcaggtaacaacctgcgaaggtggtattttgtcgttcatcatgacaattcgaattgcgccccggtgtaaccagtgcggtcggccgccgtgattggtcgaataacttggcaagggttgccagccgcaatcacgttagctggaatatcgtgggttaccacgctcccaccaccaataatcgtgttagcaccaatggtcactcctggtaatacggtgacgttagcggctagccaacaaccatcaccaattgtgattggtcgggcgatgcagccgcccctaattcgttcggttgcatcaaacaagtggttgctcgtgtaaaggccgacttttggccccaacaagacctgactgccgatcgtaattggcgccccatctaacattacacaatcatagttggcataaaagttatcacctagatgaatgttccgtccaaattcaacgcgaaaattaggatttacaaatggcttgcgaccagctgaaccaaccaattgtcgcaataaagtttctttagtctctggatcagcagtcgcattgaccgcgttcgttgtcaacgtcgcttggtcacgcaacgccgttagttctgcatccgtatctcgatacggctgaccagtcgccatatacgcaaacttctcatctaaattcattccgcaccccacttctatcgaataaaattcaagtaccatgttattgcgcagattccttgtgctgaacgaatctggccattctttaataggtcaatcactttactgagcgggacaagttgcgtattcacgtattcgtccgcgtcaaaatgtcgttcgccatgttcttgcggatcaatgtgagtcaaaatcaagctgaccgtttcgtccgtgaaaccttccgacgagctaatttgcgtcataatttgtggttcatgggcaatgtagcccgtctcctcttgtaattcacgggccgcggccgttaacggatcttcccccgcattaatgaggccagcaggtaaactaatcgtctcggcattgcgaccgacccggtactctgaacctagcacgacttgatcatccgcagtgatggctaaaatcgtgacggcgttcccatgctgaatcaaatcgcgttttacttctaatccatcaggtgtttgaatcgtttgtttgaccaaatcaaaaatcggcccatgatacaccggtgtcgttgataggaccttaccaggccggccaactttctcaaataaatctgccatacacattcactactccttaatctatctcaaatccggtacaccatccggcagcatcttacgaatgccacccgcggggtctggcacgtcaccttgatatcgcggtatcagatggagatgacaatgcattacggtttggcccgcagccggatcaacgttaatgccaatattatagccatccggatgattgtgcgcatctaggtacgcttttgcttgggtcagtaaggcgagcatcgcattcctggtcgccgtgggcacatcaaaatacgtggcataatgtgctttcggaataatcaacaaatgccccggactcaccggctttttatcgaagaaggccgctgctaggtcattctccaaaatatacggcaacggctgacaaaaaatacaagccataccaaagttcccttcctattttgctaaccaaccaccatcaattggaaccaccgtcccatgaatataatcagcgtgctgactcgctaagaatagcgtcagatctgcaacttcctgcggttgggcccaccgttttgcgggcgtctcactggcaacccatttcgccatcttaccatcgccagcaaaatcagcggcattcatcggggtatcgatagcccccggcgcaatgcagttggcgcgaattccctgagccgcatagtccaagtcaagttgtttcgtataaccaatgatggcgtgtttggctgcggtatacgctgcgccgcctccgccacccaccagtccagcgatcgatgccatattcacgaaaacgccgtgttgtgcggctaacattgcaggtagcaccgcattagtcacgataaactggcttgtcagatccgtcgccaaaatatcttgccacgttttcagatccgttgctaaagttggttgatagccgtctaacttaccggccgtattgcacacgacggttggcttgccgagtacgttaactcctgatttaatcgccgcgacgagcgcattagtgtcggtcacatcagcaatttcatagcgcagggctgacgtcgttactagcgctgatggctgtggttgccgatcaatggcaatcacgtcagccccctgggctaggaaactctggacctgggctaagccaatcccggaggcagctccagtaaccaagacagtctgtccacgatattcatcaaattgcattagtcaaccaactgccagtccgtcgctaaaatatcacaatccgttggtgaccacatactataggcttcatcggccgttttgattaaaaagtacgggttcagcgggtcgccgttgaaagtggttgccgtctgtaattcgacgaacaattcggtcccttcccaaccagtccgaacagcgcgcttaccagcttttaattcaggtaaaatagcttcaaatgtcatcatgatacctccaattattaatacccaaatcgtatcataatcccgcgtggagtgacaggcaaaaattggtaccaacaaattgtctattttactggtacggaccaattatttgtgcgataatgtaagcgaatacagaaactaattattatttggaggaattttaaatgagtaaactcggtgtttccgtttatcccgaacgatcaacctttgaaaaggatgcggcgtacctcgatttagccgcaaaatatggctatcaacgggtattcacttcactgcttgaaatcaaaggggaccaagccgcagtggttgccaactttaaaaaagtgatcacttacgcgaaccaattaggcttgcaagtaatggtcgacgtcaatcctgacctcttcaaacaacttggcgtgtcctatgacgacttgtcattcttccacgacctcggtgcctggggtgtccgcctcgacctaggattcactggtcaagaagaagcccggatgacgcacaacgaattcggcattaagattgaagtcaacatgtccaaagggactcactatgttgacacgattatggattattcacctgaaaaagataacttactaggctcacataacttctacccacaacaatacactggtcttggttatgattattttgttcagacttctgaacaataccgtcagtatggcatcaacaccgccgcgtttgtttcatcaaatgatgcgacttatgggccttggcccatgcaagacgggttatgtacccttgaagatcatcgggggttaccgattgcggcacaagttcaacatttgaaaatgacggggctaatcgacgacgtcttaattggtaacgcctacgcgagtgaagccgaactaaaagcggctgctgaagtgttctttagtccttacccactgctacacgtcgaaaccgttgctgatctatcggcagttgaagaaaaagtactctttgcgcaaccacagacttatcgcggtgatttttcagattacgtcattcgttcttctcagacccgggtcatctacaaagacgaagcctttcctgctcatcacctagatgccattcataccggtgatgttttgatcgataacgatgagtttgggcaatacaaaggtgaattgcagattgcacgccaaaatcttgaaaatactggccgaatcaatgtggttggtcatattaccaagagtgacttaccttgccttaacttgttacaaccgtgggccgactttaaatttgtcgctgccaaatagtactcaacgaatggaggggtcgcattaatgacaactgattaccgtttaactagcgatgctgaccgcgaagctttctaccaactttatcaatacgcgttcaataatcacgatacccccgcgcggcggcgatttttcatggatcgctaccaacatggctggatctacggccgtcacgatcatggtcaactggtcagtgggctatacagtctgccactagcagtcaactttcatggcgtcacctaccggatgaatggtattggcgacgtgatgagtgcgcctgaatatgccggtcagggtggcgcgggacagctgttaacgacggcgctgacagaaatggcagccaaccacgtgacgctgtcctaccttgcccccttcgcgtacggttactatcgtcgttttggctatgaacacgtcttcgaccacgcgcaccaagtcatggccgctccagacctaccacgtgtcaaaccgacggactggtctggtacgatcacccgctatggcaatgacggactggcccaaatcaacgatttttatgcacgacaaccgcaaaatcagcgtggtggtctgattcgaccagcctggtggcaacattacctgactctcaaacatcattggtcggtcgcaatttaccgcaatgcggctgccaatatcgagggctatttgatctatgaacggcaggccactaactttgcgattcaagaatgggtgactagcacgccgaccgctttcgaacgactggctaactttatcactaagcatggcaccacctttgaaacgtttagttatgatagcccaagtgcgaccaacggcttggacctactagccgacccataccgtttaaaagtgactgtccagccgtacatgatggcccgcattgttgatttatatgtctttatcaagcgctatccgtttctcacggacatccaaccaattcgcctagcagtcagtgacgctaccctccctgctaatcaaggaatctggtcattgacgcggcacaacgggcaagtaacgctcaatcgggttagcgaccaattaactggaccggctgacattcagttaacgattcagcaattaaccactgcttgctttggcacccagagcttagcccgggcgtaccaacacggattaatcaccggtgatgtaaatacgatcaaccgacttgacactagtctagttaaagaacgaccagcacttattgactacttctaagtgcttaatttagataagcagcatgactgactcaaagtgggccgccagaataatcattctggcggcccactttttgttcagacgctgactggtattgagatttgcatagattaagtcatttacgaatcagatggcaacagatactagcaccagtcgattaagctggagccgcgagcaaatcaacttaataataatgaattgccctcaaatcacggacctcattagtctccatgtttaagctaccttagcaaatacgttggttatttactcgacaggaatattccaacgcagtagtcttcaattgctattagaaagtgaggtcattattcgaataaatcacgttaatcatgatcatgctgtcgctatcactgcaacgccaacgacatttcccgctaatacattaaacaaattatgccctattaccacgtgacctaaaccgaatttgctgaacacactgcaatctctaaaaaacaactgtcatttaccttgaaccgacgagccttcatgattatccctgtcgcccatcaaattaaaccagcaactagtttaaaagcacactgttgaatggcactggatttgaatatcgacttacaaactatcaaccataattcgaatccgatgtgattaaattcgaatgggcgactgcttaaatatgacagcaaccactatttttccaaaaagatctgtctttttcatttgagcaatcatgcttaatcttccagatgtattcagaatcttcaccaactatacaaatacttaccggctacctgtttcatcataactaggtgctgtctagcaaaaattgacaattcaattaaaaacattaaaattatattagattatccatttttcatttctaatcaattcatactaccgaaaggaactcgccatggccatcaaacaacctgatttaaccatcaacattagtaatcatcaatctagcttgcaaatcttcaaagctgccgcaagtaatttcattagttcactaagcggtaaaatgttcacttttggccttggactcatgttactcgatgaaacacactctgccattagctttggtatcaacatgattatcagtccaattgttggcttgctttgccttgtcccaattggcaatctgattgatacttatccgcacaaaaccattctcactggtagcctgactgcccgcacgcttgcactaattttattcgctgctagtatcaacttatttacggcaacagcaaaactcattccaatcgttctttttctaattatcgatgcaatttcgacaaatgttaatgatacctgttattctgccgccacccatgagcttgttaacgctcacaacattcaacgtctaagttcattaacccaaagtgcaatttctctttcctcgattctatcaccagcgttaggcgttgggttatacagtttagtcggcttttctggcttcgttatattagagattgttgccacactcgcctcatttggcattatgctcacaatgaaatttcattatcacgcaactaatcaattcgctaattcacaacacgccccagtaacttcgcacagtcagtttgcaaaatttcattctggtctaaattacatgcggtcgcgaacaatgattaaaattacaattctgttgagtgttattctgaacttcttatatactgctgttacgattggaattccgtacatcttaaaagatcagcttcacacaggtaatggtcctattggcgtgcttgaaaccgggagcgcaattggtatgctacttggcagtctacttttaactttgctaccgccaaccggtcagaaacgtctctttttaaaattaattattccggtacttattcttgatagccaaatattgctattaggtgttctgttcatgacgtcccaatcaccaactggatatgccctgcttggtagctttatcatgggaatattggctttcgcgcttgttattcttaatataacttttcaggtctacttgcagcaaaccgtgccaactaaattactaggccgagtcgttgcaacattaacaacagtcaatagctcaatcatgccaatcggaacacttatgttcactttaatctttcaaagtaccactcatggcggtctcgtactaatcatcaacggaattctactacttgggtatacgttactgctgttgcggccattaaatcaggccattcatagtgaacagccatgagtcacgtatcatcaggcaattaacaatcccgattgcgatggaaaacgttgctttcgactttcaacgggctcaccaccgtgcttctatcacttcgagccctcataaaaccgccaataaacaaattattgattaacgaccgacataatacctaggaattataccagccaatgttacgatcaacatcacgaccaatcgttatgaacaactagcgcttttgcaacggcaaatagttattctattcaaaaaagatgtttgaagatccgactagatctccaaacatctttttactgacattatcctggttaatcaccagcatcgtgcgtaaataaaactaacgaatatcaattgattaccaatgtaatattaaccatgtcttgacattaattttcatacaaataacccgcatcccgtaaagctgccttgatggctgttaattgttccggggtctgataagcaaccgtatggctatggacgccatctgttaattctgataataaatggccttgtaatttcttgagccggcccataaacagattaacatcaccaactgagcgaatctctaattcaccccggagccggccatacaatgggtgttcgacttcaacatccttgattatgccccctgcgtgaatgatcaaggccatttcctgcatcgcttcgtttggaaaatgacggcaaactaggacagcagttggctgatccgctttttctaattcatacccttgaagagtagcaacaatggccgttccgtgagccctcaataatgaaatatccccaacaatggtctgacgactaacgttaaactgcttcgctagcgttgttgcacttacggggacctgcgtttgcgataattttgatcgaatttgttcacgccgttctgatcctgtcatgactcacccttcttactctttcaatagaatcattctaccagaaaaccagtagaatagctttcatcaaatactaaattatgataaactaagtttatttaccataggtgtcaagacacctaaatcttaataacgggattgattagcaatgcgcaatttatctttattaaccgacttatacgaactctcaatggcaaatggatttcatcacgacttacctcagaccaacgccaccttcgaccttttttatcgccgggttcctgacaatggtagctttgtcattgcggccggcctccagcaagttgtcgaagctttacaagattttcattttaccaacagtgacctcgactacttccgtcaacttaacctatgggatgaatccttcttagccatgctggcaaattttaagttaacttgccaaattaaggcactaccagaaggaaccccggtctttcctcgtgaaccactattgacaatcactggaccacttgagcaagcgcaattacttgaaacactcgtcttaaatatcgtcaatcaccaatcactgattgccactaaagctcgtcgactgagttatgctgcggcaggacgtccaattatggaattcggtgcgcgccgtgcgcaaggcccggacagcgcgctttacggcacccgggcagccattattggtggcgccaatagtacttcaaacgttctcgctgcgaaactgtttgatattcccgttgctggtaccatggcccacagttggattgaagccttcccggatgaactaacggcgtttcgcaagtgggccgaacaatatcctgacaatagtgcgctactagtcgatacttatgatgtgcttaactctgggatccctaacgcggtgacggtctttaaggagctacgagcagctgggcatgaacccgtcggtattcgaatcgattcgggggacgtcacgactttatcacaagctgcccggacacaattggacgcggctggctttcccaatgccaaaatcactatttctaacgcattggatgaacacatcattacttcgctgttgcacgaaggcgcaccgatcgataattttggtatcggtgaaaagctcatcactagcgcgtccgcaccggttctaagtggcgtctacaagcttgcggcaactgagagcaatggtcagagcacccccaagatcaaggtcagtgccagtcgcgaaaaactaacgattcctggtgataagcaagtctatcgtctgtacgaaccaggaactcagcgggcctttgctgacttgattgcactagctaccgagacgatcgtcgatgcgaccagcctaaccgtcgtcaacagtgacccactcagtgtcgaccgccaacagcgactcacccattttgaagcccggcccttactcgcgccggtagatttgtccaacaccacgtcaattccggttacaaccattcaggcaacgacccaggctaaacttgccgagctcccacgaacaacccagcggctcgtcaacccagatctttacccggtctacatgacaaccacactcagccagttacaaactagtttgttgaataaaatgacgatactagcagattaacaaacgaacacgcgtagcaacgactaaagccacttctgatcagcgttcaaatgaccgcttagtacagaagtggctttagtttataacaagtaacagttagctcactgaccagtaatttgatcatgttcacccggggtcaatattttggtcatcaccgtaatcaaatacgcttgttcgcgctcaatttcagttcccggcaattctagcattaaccgcgctaggtaaccgaatagctgcgataacaaactttgcagtatcaaatcattcggccaatccacaatcaaatgatccgcttttagttgatttatgacacttcccatctgcttgaccatcttaggcgcgatccgactaagaatctgttcgcgtcgttcggcgtcaaaagctgccatttcaaaaatgacctttaactctttcacgttagctttagcaaatgcaactcggtccgtaaaaattgctgtgacgaatgcctgtagactgggataacgctgccgtaattcatcttctgaaaaatcactcgctaaaattggcacaatgtgcgcggcaattggtgctaagatggcatcccgtaaggcagccttagtcttataccgccgatagaccgtcccctcagcaacgccggcccgttgtgcaatatcactagtactagtctggtcaaaacccttttcagcaaacaaatcgagacttgcctggaggatggcccgttgcttaggtgtaatcgtttcattctgacttagatcatgttgaaaataatcccgtatccgtggtcgttccatatcctcacaccttccgataacgtttcattccaacaatattcaacattgttagtacgaccataaaccctactaatattaacaaattgacaccaatatcgccaagcccagcaccctttgtcacaacagccgtcaacgcattagcaccatagtataacggcatgatgtgggcaattgcttgcaaccaactcgccatgccatcgactggaatcaacccagcaaaaaagatttgtggtacaacaatcagtggaataaactgaatcatttgaaattctgagttagcaaaggtggaaataaagatacccaaggtcaaagccactaacgctaataataagttagtcagaaagaccagccaaatactaccaactaagtgaatcttgaagaccgtaattgcaaaaacaacggtcaggacagtctgaatgatggcaaagcccccataaccaattagatagcccataataatttcactccgtcgaattggagttgcaagtagccggcttagggttccagtagtgcgctcattcaaaagtgaaacgccagaaatcaagaacacaaagaagaagacaaagaaaccgagaaagattggcaaaaagttttcaaagaacgttgaatcactactaccataaatataatgactgctagtggtataggtcgtcgtttgtgattgactatttgttggcgccgcagcactcgctgtagcctgcctcaattgcttttgaattttagccgcagcagcagtattcccacttgcctgtgcttgggccaaggccgtctttagcttgctaaccgttgcctgtttttgcgccgcggtcaacttttgtagtgccacctgttgcgtttgcaacacctttttttgtgctttagtagccgtgaccaacgtttgaatttttaatttgaccagtccgctttgcaaagaagctttgatcaatgacgtattggtcggattactattagaatacgtgatcgttaagttgccatctttttgcgtcaaatatccatccaaatcatgctgcttaatcatcgcttttgcctggttactactgtaatggtgaatatcgacatgcttcgtattaatggctttgaccacctgatgatcaacattgtgaacacctaaagtcgccacttgagtcgtgttattttgaaacaaaaaatacatcaacaccataattaagagtggtgccaaaaacatcagcgccaaggtacgcttatcacgtaacatttgcttaaaaactcgtctaacgattgccatcgttcgcatcttgcatccgccccgctttcaaaaagacctgttcgatcgtatctactgcatactgttgtttcagtgccgcgggtgtcccctcagcaagcgcaatcccgtgccgaatcaacatgagataatcacaccgttctgcttcgtccatgacatgcgttgtcacgagcatcgacttaccggtatccttgagtttatttagttcggtccaaatttgttgccgtaattctggatcaatcccaacggtcggttcatctaaaatcaataattggggatcctgaatcagggcaattgccaacgacaagcgccgtttcatcccacccgaatagccactgacccgcttgtctaattgggacgctaaatcaactaatccggctgcataatcaatcatctgtgctaactttatttttggaacactcattaattgcccaaaaaaggtcaggttttcacgggccgttagtgtctcatacaaagcgtcactttgggccatataccctacttgtgccattaccgccctattgggcatcaccgtatccatgactttaacagtgccactgtccacagcctccatccctaaaatactcttgatcaaggtggtcttcccagctcctgatggcccaatcaagccataaatcattccagccggcagtgtcaaatcaatctgattaagcacttgctgatgaccaaagtgcttgctgacctgcttggcgatgacataatccgttgccattttaataaccctctttctcgaagtgagtgtatactcactcacttaatggctttagtataatcagtacatctcggtttgtcaacagtaaaatgagttgtcactcacttgttttatttccggcccatttgtcaccgcattgcaaacaaaaatgcgccaccccgttgttggaatgtcgcattttaattaaatatcagcactgatataagcgttagcaatgttttaacgattgttaatcttggtcagcaatttttgtcctagctcataatccaactgacgctccgattccggcatcatgtcgccgccagttgcccagacaatgtgggtgacgtctttgccagcaagcgtgggaaatcgggccatgatgggggcgatcgcggtaaagccggctgcagcggatggttcgaccattacatcttcggtatcgacgagcttcgtcaaataacggtataaatcatcatcttcaaatgttgctgttccgagtaatagcgttcgcatcaccttgcccgccaatcgtgatggccggctaacggctaacccatcagcggcagtcaggccatctaaaccaatgtcttgaacagcaattttttcattcagcttggtcatcatccctaaggtcacggacggcacgtgggtcggttcacaaaagacgggataaatattagctcccataatcatcttgaggccaaaagcaacgccactaggactgccaccgaccccggccggtaaataaacgacgaccgggtgcgcagcatccatcttgatgccttgtacttttaattgatgttgtaaccgtaccccagcaacagcgtacccgaggaataagtcacgtgaaccttcatcatcaacaaagtgcgtatggtcatccttggccgcggcggcgcgggccaccggaatcacacttgaaaagtcggtatttagttcctcaacggtgacgccatttgcccgtagcttgtccttcttccactgacgagcatcgtgagacatataaacggtcgtcttaaatccaaacgttgcggccatgatgcccacactgagtgccaagtttcccgtcgatgcaacgatgacgccgtattgtgcaaataactcgtgatacttagccgttgccaagacactgtaatcatccatatacgttaaatccgtatgggccatggctacctgttcagcaaacttgagcacttcgtaaatcccaccacgtgacttgatcgaacccgaaatcggcaactgactatcagcttttaaataaagctgccccgccaatgactggtggttgagagcctcccatgctggtttcatctgctcaagtggtaacaatggtgactcaataatcccattcatagctgccgtttctggaaaagcaacggccaaaaatggtgcgaaacgttcccaacgtgcgaccgcgtcaaaaatatcggcccgcgttaacggcaggtccgcccgcttcccataatctgggttctgccaaacaattggtcgttttgctatcaattccttaatctgtgggtgttcttcaatcattaccgttgtatccatactttcaggtccttttcatttaattgcatcatattacgtatcgtgagttaaaattatcagttttcgatggccgtctgcatacgttcagcctattccgaccttccgagactaggtaacatactgaaacgtcaccacgatcagcacaaatgccgataagtcgatataacacgcactgagccaacaagtctcccccaacccgaccctttcaaccgaacctaagttagtggcttttctctgaatctaacgattttcaatcacaactcatgttagataatatgacatcaccttcgtccatcatttaaccacatttgatacttagaaacaatctttaggcactgattaacaataattgttgattaggtagattgtaaaattaatccgaacgctgttcggacaaaaaagatcagcttcctttaaaatggtgtttaccacaaacccatcttttaggagctgatcttttgtctagtataacctattccgaacgaattaaaatcgaaaccttttgtgaactagggctgtccaatatccaaatgggcgttcggctgaaccgatcaccgtcaacaatttcttatgaattatctcgatgtcaaccttatcaggctgaattagcacaaacagatgccgaatacaagcgatcacgatgtggccggaaaactaagctgagcgatgagttaaagcaaaaaattctcaaccatttacgtctaagctggtcaccaggaatgattgctcacgaatttaaactagctactaaatctatttataattggctaaatcaggggagaattgatttctccttgaatgatctacctgaacatggcgtacgccaacggcgtaacgttgaccaacgatccaaatataatcaatctttggggcgatcaattgaacagcgtcccatgatgattaatcaacgtaagcgcatcggcgattttgaactagatacagtcgttggtcctcgtgggcatagtaaggcagttttattaactttaatcgatcgcaaatcacggttcctttgggcataccggttaaaagatcggacgacagcgactgttaatgaagcactaactaagttcctaaccacttttaatggtccggtgcacagctttactgtggaccgtggcactgagtttagtgggctagtatcacttgaatcacaatatggtattaagacctattactgccatgcttatacgccagctgaacgtggtagtaatgaacgctttaatcggaatttacgttatttttatcctaaagggactcgttttgagcacattagtgctcaagatttaacgacgacgttactccaaattaaccagcgaccgcttaaaatactcgactggcaaacaccgtatcaggttatgctgacaaatttgtccaaaaattcggattaaatttgcaatctaccattagccaatcaaacaagctaataaggcaatcgaaaaacgacgttcaaagttcactcactttgaacgtcgtcttcaattagtggttattaattgactaataatcgtcgttcgaactgcataatcattcagtagtcttctagcacaacgagtttcctacttcaaatcggccccattcgtccgaatcactttttgataccagtagaacgaatccttcttcgagcgctctagtgtcccgttaccttcatcgtccttgtcgacgtagataaaaccgtaacgtttcgacatctgaccagttccagctgagaccaaatcgatacaaccccacggcgtatagccaatcaagtcgaccccatcttcggtgacggccttgatcatttcactgatatgagcgcgtaaatagtcaatccggtaaggatcatgaatactaccatcggcttcgactttgtcgcgggcacccaacccattctcaacaatcatcattggcttgtgatagcggtcttgcaaccaattcaaagaataccgcaaaccttctggatcgattggccagtcccattcgctcgtcttcaagtatggattatcaacggcttcggtcccgacaaagtggtagcttgggttatcatcctgagcggcgaccgtgttggaattatagtaactaaagccaatataatcaacggtgccttccttcaagacttggcggtcttcggccgtgatatcagggcggaaaccagtctgtttgaagtaagcttccatattatttggataatagccccatgactgtacgtctgcaaaccaataacgccgctgcatagccttttcagcttgcatgatatcttgtggcttagcagttgcaggataaatcggtgtcatgttgatcatattgccaatctggaagtcgggattaatggcatggccaatcttaacggctagcgcactggcaacgacttcataatgagcagcttgatacatcaaagcttcagcgttaggatcatcgggcttcaacactaaaccagaatccgtcgccatcaggaattggttcgtataagtcgtctgattattaatttcgttgaaggtcatccagtacttaaccttgttcttatagcgtttgaagaccgtttcagcgtagtgcacgaaaaagtcaatgactttccgcgaacgccagccaccatattccttaactaagtggtacggcatttcaaagtgggccagcgtgatcactggttcgataccatattgccggcaagtatcgaacatatcatcatagaacttcaaacccgcttcattgggttcttcttcatcaccatttggaaaaatccgcgtccaggcgatcgatgtccgaaaacacttgaagcccatctcagcaaatagcttgatatcttccttatagtgaccataaaagtcgatgccttcatggttcgggtaattcttacccgcaatcacaccatccgtgatttcacgaggaacaccgttggcaccggcagtcatgacatcagccacactgacccctttgccaccagcttgccagccgccttctagttgatgggctgcgaccgccccaccccataagaaatcagatcgtaaaccactcgttgttgccatgcattatcatcctttcactataaatcttcaccatcactcgcaataacttgttggaaccagttaaaggagtctttcttagaacggtcaaaactgccttgaccattatcatcggcgtcaacataaatgaatccataccgtttcgccatttcaccagtacttgctgagaccaaatcaatacagccccacggtgtatagccaatcagatcaacaccatctaatacgaccgcttgttccatcgccaagatgtgatcacggaagtaactgatccggtagtcgtcatgtacactcccgtcggcttccttcttatcgtaagcaccaaagccattttcaacaatgaattgtggtaagtgccaccgatcttgcatccagttcatcgcatagcgcaacccagttggatcaatttgccagccccaatcagacttctcaacgtaggggttctcaacaaagtcatcgggttccttgaaatcgtaatcactgtcaccgtcacgaccctttgtaacaaatgacatgtaataactgaaaccaacgtaatccaccgtaccagcctttaaagttgccaagtcagcagcggtaatatccatatcgaagcccttgcgttcaaagtacttcggtaaccactttggatattcaccgagacagtggacatccccgaaccaataccgtttttgcatggcccgttccgccatcatcacatccgctggtttagctgttagtggatagattggacacatcgcgaccatacagccgatttgaaaatcaggattgattgcgtggcccgcttgcacagctagggcactcgctactaattcataatgagctgcttgatacatcgcctgttcccaattgtcatccttgctaagttgcaggccggaattttgtaacaatgggtgcggatcactccaagctgtttggttattgatttcgttgaaggtcatccaatacttgaccttatcctgatagcgcttgaagacggtcttcgcaaaatgaacaaagaagtcgatcatcttacggttgctgaaaccaccataaaccttcactaagtggtatggaatttcaaagtgtgacagggtcacaacgggttggatgccatgcgataataaatcatcgaataagtcatcgtaaaacttcaaaccagcttcgttaggctcgctctcatcaccattcgggaaaatccgggtccacgcgattgacgtccggaaacacttaaagcccatttcttcaaataatcgatcatcttctggatagcgatgataaaaatcattgccccagtgattaggatagatttcaccatctttgacgccatccgtgactttacggggaaccccgttacgtccggctgtcattacatcggcaatgctaacgcccttgccatcaacatcccaagcgccttctaattgatgggccgcgaccgcgccaccccacagaaaatctttgggcattttgtatccttttgtcatgaactaattccctccattaatgctgctcaggctatccctgagttacagtctttgttaccttaactaacgaaaagcgtgtaaccgccacgtcaccgttgttaagctgtctgccattataagcgaccacggcatgaatgaaaaaacaagcccagaccaacaccagcaggtatttgcctaggctcaaattaattaactacttcgcctcatcggcagctaaacgccgataaacgtctacaacttcaccagctaagtcgcggaaggtgatggcattcatgatgtgatcttgtgaatgtactaataacaatgacacgtgggtatgttccccttgtgcttccgccgttaacattgaggtttgtgaattgtgtgcttcggttagaaagttatctgcttcctttaacttggcatcagcggtttcaaagtcgccttccttagcagctttaattgcttcgaaagcggaactctttgcattaccaccattaacgatcaaacccataatggtttcgagacttgcttcaacttcttttgtttgttcttctgccatttaccctcatccttttagcatttattcgtgtgcatcacaatcaaaatgccaccggccgcgattgatctaccttgggctggtagcacttacaatttaatgattagtttgcttttgcaattgatgcttcggcttcctttaaaactttttcgccgttcatcatgccgtagtcttgcatgttgataacttcaactggaatatcaacgcgcttttggaaatcacttaacatataacgaacttgtggtccaagcattaaaatgtcaggattcttttcagctaacttcgcatcagcgtcactggcagcggttgcaaaaatatctgcatcaatgccttctgcttccgcagccttttgcatctttgagactaataatgacgttgacatcccagcggcacataccaacataattgttctttcagccataataaacacgctcctagattgttttaaatttatatgttacagcggttgctttaataaaccgctttcattacaattagaattataagtcatgggtacaaatttgacaagccttattaatcagatatctgcaatttatttgatttatacccacaaattattaaataacaacttaatattcgaaagaagtgaacaccatgtatcgtgacattgcaaccaaactcgttgccgccattcaagacggcatttttaccgtcaaactccccacggaagcccaattaatggaacgttaccaagctagccgcaacaccattcgcaaagcgattgacttggtgtaccagcaggggctcctgcgtcgggttcaaggcagtggctattatattactaatattcagcttcaacataaaacggtagtgaatctgtcagcacgctcactcttcaatagtcatgtccacccacggactttaacttccaagattctgacttttgatacgatccacggcgatagtgccctgagccgcaaactcaacattcccgtcgacgaagaactgtatcgtatcattcgcctccgctattggcacgaccaactgtattgtttggaaaaggcctactacttacgctctgtcgtcccctatctatcgaccgaagctgtcaatacgtcaatttgggacttcatcaacgaagcttacggcatcgggattgctaacagtgatgattatctttcactcaccaatcttaacaaggaagaggccgaactaatgaatttggcacagggcgcaactcacttggccttggattcttgtaactattataagaataatggcttactagatttttctcacaccatctttgtttatcccgacctcgcattgtattttcatacgacaaatcttgcaaataattaatttatggctaaaaaaagacgattcactataatttcatcacaatttatgggtatactagtaacagtatccaaatttacgatggaggaattagcgtgtcagcaccccttttttcagtggttgtaccagcttacaaccagcacaaatttatagatagctgcttgactagtctacaacgccaaaccttgacagactttgaagtcttcgtggttgatgattgttcgactgatgacactggtgaacagattgccgcgttaatcaaaggcgacgaccggttccacgtgatcactcacgcccataaccggggcgtctccgcagctcgtaactccggtatggctgctgctaagggtaagtacctttgctttgtcgatggcgacgattgggtcgaaccagactttctggcaaccttcctagccgcctaccggtcagcacccgatacccagctcgttgtatgcggtcactacggttacttagccgttccgagtcctgccaaaacatacaaccaaaaagacttgattgccaacatcaactttggcacggttggcggtttttcgtggaataaagcattcattcgcagtattattaccacgcaccacctcaagttcaacgaagatattgattttcttgaagaccagttgtttgcctttcgttacgctaactacgtacagtcctccgaatacgtaccggaccggacttaccattaccgttggcgttttcgaagcaaccttgctcacattggaattccattcttcaccgctcgtcgtaagatgatgaagattctcaagcaggaaaacaagcaagttttgaacgaagattggaataatcagtagcaacgttacgttgccatcgcccctaaaggtcggtagctgaaatagctatcaccctttaggggattttttgatacctagcataatcggctacgatgaccagaagatgcgcaattattcgaggctagtagccatccactcgcagtctcaaatgcgctttcgccgccgattaaaccgaccgtggcgcgaaacaagctagctactcaagctctttttgatatcagcgacaaaataaagtggcaattaacaattaaagacttgttgaatgacgagtaacgctttacaattggactatattaattaatttgatgggagggttagcgatggctacgattcacttatacttagtccgtcatggacaaaccaagctcaacgcggccggccgtttacaaggcatctatgattcggaactcacacataccggtgtgcgctccgctcaacggttagcccgcatgctagcagatgttcatttcgacgctgcttacgtcagtgacttgggccgagcacaacaaacgagtcgcattatcaccgcactccatcctgaaataaaaaagccgacgattgacgtcggcttacgcgaatttaacttcggtgggcttgaaggtaccagaaacatgtggatcgtcaagcaagtccaaaaacaattgggcattggaacgtttgttaagttgatgttgagtcgtgaacgcttcgccaccctactatgggtctttaactccctcgaccagactcgtggcgccgagactttggtcggtgtcacggatcgaatcagtagcgcgctgcgacgaatctgcttgtatgaatctcaggatagtcagcatgacaagaatattcttatcgtttctcacgggctggttctcagtgcattcctataccaaatcagcccccgtgagcttcccacccgactcctgaaaaatacaagtgttagtcgcgtggactaccaaaatcggcaattcaagttgatcgacattaatatcacccctaagaagcgggcctagttgtctcgatgctaacaggttgcgtggtacaactcggaaattgcaagcgcgcctgaataccaaaaaaggctttgattttgcgttgtaattcttgaccagttgcatgcactgaagcttcacttgcatctggatcgccaactacaattaaaatgcgactgcttttactatccaaattaggcctgattggggtggtagcatccgctgaaagactggccccttgtgccgttaaatgaagctgaacctgctcagtgccaagcgtattcatatcccacgcattgatctgcactggatggcgcgcgtgaatcacttgaagcaagtctgccaaagcattctgcggctgagcaacggcaagcccttgtgcagctaattgtttttcaattgctggattcaactcacggttatcaagattgctcatcgacaaaattgctagtggaatttccgtggtagtcgtcggtaagatttcaattttcaacagttatcacttcctaaaaacacttcaatactaagtgtgccaaatttgacgtaaaagtcaattaccaccacttaagtcatagcgaaattttaataataccacaaaagcgattcccacacacgtgagaatcgcttttttaatggccttattgtcctcgtcgatacaccgatacgcttgtaagctgaccttacttagtcgttgataatgggtgggccgcaaagtatttttctaagaatagtgccaaaccatcattataattcatatcagttacatagttcgcaactttcttaacttgtggcaaggcgttgcccattgccaccgataagtcagcttctgccatcatcccaacgtcattcaaaccatccccaaagacaaacgtgtgggcggcatcgacatgttgctcacgttgaatttgtttgaccgccgttcccttatccgtattcagaggaatcatctcaatattattcgggttcgatgatgaaagtcgcaacaatttactattagtgagcttttcgcgggcagaatccagccgtgacatgtcttcacgactgagaatgacgccgttcgtaatctggtcctcaatcgtggctaattgcgtaaagctcttcacttcttcatagccaatcgagacttcatccgcatcaaagttagccgcattacgagcaacgaaccgtgggatttgttccgtatagtaggccatgtctggcgtgaacaacatcattggtaagttatcacgacgtgcaatcagataggcaagctcaaccgcagcacccccgagtttggttagctcacggccctgggcaccatcgaacaccgccccgttagacgtcaccaaacgaacgtcagcgtttactttgtctcgaacaatcttcgccagttcgtacatgcgccccgtagcgatgtaaaataacacgtcctgcttctgaaaccgttcaatcgtcgctcgagttcgctccgagacatattggtgatccgttaataatgttccgtcaatgtccataaagactaaatattttggcatagttgaactcctcctacgtatttacctatatgttgtgctagctaactgatcatctgtgacattcagcttgactgcttttgctgggtttgccaatcagtcggtaccatcctgccatcgtcagtaaatacgcaaattggcgtatccgcactgatgagtaagccggttggccggacttgaatgggcttaaattaaaaagatgacgcaccgccgccttttttagcaatcataattagcacaaggcttatttacactcccaattgtacgctattccctcctataatggaaatcgctttcaaaaccgaactagccaccgcattttcaccacgtaaggctaaacaatcttaagtttagaagctatttagagcattatttgccctcatcagctttatataccaaagaattcaatctcactacttgacattcaccagtctagccgctaaattagagaacaattaataaatgatgataaaaagcattgaacagttcagtagttgccggtcgttagccttagcgagtctgagatggtgtgagcagacctaatccggtatcacgaatatcgactgtgagttgtatgggtgaaatcaagtaacccgtactggttaacacccactaacgtgtagtacatctttcatgatgtgcttaaggtcagtaatgtaaattgctgatgaataccggtggtaacccgcgctcgcgtccggcagacgacttcgtctgtcggacgtttttattttcatttattaataaatcattttaaaggatggtcatacatatgcattttacagtactcggcgcaggcgccatgggattacgttacggtgtgttattacaagaagcaggcaatcaagttgattttgtggatacttggcaagcaaatgttgatcaaattcatcgtcaaggtggcgtctacgtgtcgcgcgatcaccagaatcgacacttagttcccgtcaaagtctcaactcccgaagattatcacgatgatcccgacgtgtgggtcgtatttactaaacagatgcaacttgctgattttttgactcggacggcccacgcttttaatggtcgccagtacgtgctcacttgcatgaatgggatgggtcacgttgcaaaattattacactacttcaaacccgaaaaattattagctgggaccgcactagtcgctacggtcttaaacggccctggtgatgtcgacttcattggagctcgcggcgccggcaccatgaatctcgccaattatacggaacaccctgacgaaatgacccaccgaatcgtgacagaattagataaatgccaattccaccctaatttaacaacgaacttccgcggcaccttgctggctaaagtcgtcttcaactcagtggtcaacaccctctgtaccctctttgaaattacgatgggcgaattcgcggcctatccaggggctgatgagctgagtcgtcaattgatcgatgaagcctatgatgtctgtgagcgtgatggtgtcaccatgttgaatacccgcgcggaagagctcgcctctgtcaactacgtcagcaaagtggctaatcccctccactacccatcgatgtatcaagatatgtctcataatcggccaactgaagtcgactatatcaatggctacctcgtcaagctcggccaaaagtaccattaccaagcaaaaacgcacgcgtttctgacccatctggttcacttggccgaaaccacccgccaaaccagtgccacaactgaacacactactgaacaaaatacgcagaacgcgaccgaacaggctagtcaacaagcaagtgcgtaaccgattccccttttctcagcaaaatcatgtacaatggaggttaagttgattttactgaggaggcggtttgctgtgcaagtcagtcgggaattcaaaggtatctttcttgctagtatcagtgcgaccttctgggggatttccggagccgtcgcacaaacactttttgatacgaccgatattaattctatttggttaacaggaattcgcatgctgggtgccggaatcgcactattactggtcagtttactgacccatgttgatttgtggtcgatttggcgtcaaccccgtgatctcctacagatcgtggcctacacattattaggcctaatgccggttcagttcacctactttttagcagttgaagctagtaacgcggcgaccggaacaattctacaattcatgggacccgtgttcattgctctgtggatgctagtcgctcatcggcaattgccgacccgtgcagaaggccttgcgattatttgtgcactactgggctcattcttgctcgtgactcacggcaaccctcagaccctagtcatctccgtctgggcgttgatctggggactcttatcaggggtctcgtccgctacgaataccttgctgccaaccaagctactcactaagtacgacccaatgaccgtcaacacctggtcaatgttgttagggggtatcttgtttaacatcgttcagccagtctggtcgatccatattccactgactatgcttaatatcagcaagttgacctttgttgtgctgtttggaacattgttagctttcctattcttcttgcaaagtttgcaatatatccggccaaccattgtcagtctactagacgcttttgaacctttatccgcaaccatcattgcggtggttctactcggtgtcagcttcggttggctcgacattctgggcagtgtcctgattattagtaccgtctttattttggctattgggcagggtcccaatgatcgcacggcagagaatttcaaacaaccataaacgatgactcataattatgaaaccagtaaaagccggttgtgactaagtcctagtcacaaccggcttttacgttgccgctaccgttacatatattcaattaataaccacgattcagatccacttggttacgtaccagcgtgccatctttgacaaactgtgcaaagttcgccgcaaagattggaaaaacggtcgcccgaaagtgggcaatttgacctgaaatatgtggcgtaatcagcacgtcatctcgttgccacaacgggtggtccgccggtaatggctctggttcagtaacgtccaacgctgccatactgagttgatgatgatccagggcggccattaacgccgtagtatcgaccgccggaccacgcccaatattaatcagcatcggttgctgtttggtctgctgaaataattcagtactaaacaaatgatgcgttgttggcgttaatggcaaagcgttgacaacaaagttagccgttgctaacgcgtcggccgtcgcagtaaatgccactgtttcatgaaaatgatcagcggggtgaccggtcgtattgaccccaatcacgtgcatgcctaacgcactagccttagccgctaacgattgcccaatttggcccgtgccatatatcaacaactgttgcccggtcaaggtagatgtcgtcattggcaaggcccattgccgtgccccgcgctgattcagccaggccgcatggtacccccggactacgcttaacatcgcggctaagaccgattcactaatcgcatcggcgtgaataccactcgtgttcgcaaccaccaccccggccgcttgcaatgcctttaatggcaaataatcgacgccagctgaaatgacctgtacaaactttaactgattggttggccgcgctaggatcgtctttaataacggatgattaccatacatgacttcaatttggtcgtaatcggccgccgtgaccgccgccgcatccttgaacgtccagtccggataagtggtttgtaactgttgcagctgttcaggtttggttgcttgagccatcaataccattggcataacttattaccccatttctaatttcttgatcaatacttttatcataccactatcattcacttgaaccgtaatgatccacaaccggatattagctaagattggccagtaagttaggctgacccttttttagcccacagtttggtttaaatcacaatgtttgacgctactgctgacaaacggctcgcaaaataccaacaaaaaagcgatgttcgaaagtcgcactcccgagcatcgccaatcggtaactaacctaattgggtttaatcgttgaccaattatttaacaaccgcaaagccaccggtccagccgatttgttcactggctgctaatgtcatttgcataaaccccatcgcttcaagctcacgggcccgctttaacttacctgcatccttcacttctaacggactgtcagccaaggcgcgggtgaagcgttgcttggcgctatcgtcattaccagcaactaacacggttgttggttccttaccattgacctgcccactctgaagcgtcgccgcaaaagtcgtattgaaagccttgagcacctgactatctggtagttgctgctgtaattcttgggcagccgaactatcagctggaacaaccaagtcatcccacgtgtcaaaattcaaggggttcgtgatatcaacgacgattttgcccttcaactgagtcgcgtactgtttagccagcgcagctaaagcgggataaggtaccgccatgatcacgatttcaccgagcgttgtggcttggtccttggaaccataataagtgacctcgtgcccagcgatttcaaaattatgaccaattgcttgccccatgttgcccttaccaaaaattgtgatttccatatcaaaacacgcctctttcactttataattaattttatatttacattctaacattgatgtcccatttacatcacttttatgtctgacagttaccgcaaaccggtcgtcaatcgccctagctagtagtcgctccttgaatgacgacaattagtggaactaatggctaatcagctcggatattcacctgcctgcacgcttcccaggttattgacacgagtcgatcagtcactaacgaccaaaaaccgaccaacttaattatgaattaattaagctggccggtttttaaattttcagtcgatcatcaagtttactggtctgttacccccaaaaattaattattgcccgttgccgtactataaccatctgtagaagaagcagtgccaccggtcgttgttgaagacgtatctccataattcgtcgttgagctactatcggtgtttgcactataactgtagctaggcgtacttgagcttgacgttgccgagctcgtgtccgtatcgttgctataactatgcgttgaagccgaactactgttgtcactactttcactataagtcgaatatgatgaactcgacgatgattctggttcactatagctatacgtgctcgaacttgaggttgaagacgatgcgttattcgctttcgccaacttcttgcgatccgtaatcaacttctggtaatcatcggccgctaactgcgactttttgcgataagctttcaggtttgcaagtactttatcgactgtcgttgacggggtcgaagccttgagtttatttttcttgttatataatttttgaaaatcagcatcatagctgaccactttcttaaccgtttttcccgttgtcgtaaacaacttgtcatacttcttagcaaagtacggcttactactcgttaagccagcagtcgtcaaccgctgctgacccttagtaatggtgtccatggtcacgtcggtcttaagtaaccccttagcgttgcgtaaatcttggtaactagtccggaccgtcaacatcttagcagccgtatcatgctgtttctgcaaacgggtcttttcacttgaatccttcatattatcaatattattttgcaacttggtcaaagtcgagcttgaggcactcgcccgcaagtcccgttgggctgatgatgtataaacttggtccacgatcttttccgcattggttcgtgccgcagcttgagtggcttgcccatggttccacatgaagaaagctccaccagcagcaacaaccagaatcgcaacaccagccaacatcaacttccagttatagcgccgagctggcttcttaagatgtggattcttttcatccgtttctaactcagaaaagtcacggtcgtcatccggctgatcatcatgtggtacccgctgttcttcgtgccgagcgacccgtgacatggttggcttattgggctgcttgccaccgttgggctgctgatcaccatacaactcttcacgtgataatggtaactcaggctgcgtgtcatcatccgcttgttccgtccccttgaccgcaatccgcggttgctgtttacgagcaaccggtggaatatgatcagctgggatgcgcctttctaccttcggctgtttagcagcagtcgcttgcggatccttagcggttgtggccgtggcctgagatacagcagcctttgatgtcgctgacttgggggctgtggacttcggggccgtggattgtgctaccgcagatgcggcggccgcggcactcgatgtcgaagcactagactgttgactgtgcgtcttggcctgactggcagcttcctgactagcacgccgggccatccgcgtcattggaacttccgacgttgccgccgactgatgaaccttggtacttgctgttgttttagccacacgcttctgatcagacactgcggtgctggttgcttgtgacgcttccttagcggcccgcgctggtgccgattgagccgcactagctgtcgtcgaagctgcgtgcttggaacgctggtcacttactgcctgtgatgagaccgcgctggccgtctttggcgccgcctgacttgctgttgaggccggtttagttgcggcggactttttagttatttgcgcggattccgcctttgacgacgactgagaaccagccgagcctttttgcttaaccgcactagtcgccccatgcttgacgggtgccgccgattgttttacagcctggcgatcgtctccggaatggcgcgcttttttagccaccttttctggttcaattactgcgtcaacaggttgcttttcggcactgttattcgccgtcgagcggggaatattgaccgttgattttgcttcggcttcgtccgcctttgatgcggccgagtctttcagatcataggccaaagggatctgttcattatcttgttcagtactatcatcgtcgggaattggctcagtaatcgaattccagagccgtctacccaatccttcttttttattttttctagacaaaaccaacgctcctcgccaatttataatttacattagattcctggttaagcgccgaccaaaaatttttatcaatttcggtaaaataaccattaatagttaaattatagcatggaattggctactgagaaaccactggtcaagcggatttgtgaataactgcccaataccttaaattaaggttaaaactctgctataatcggcttatcaagatatttgaaagcgaggagttcatatggctactgcgaaagttatttttgctaccattaccggtaacaacgaagacgttgccgatactattactgaaaaatttgaaaagcttggggtcgatgttgccaaagaagaaatctcgcaagccgacgcaactgaattcaacgatgttgatatttgtgttgtcgtcccttacacctacgatgagggcgccctccctgaagagggactcgacttctacgaggacttacaggatttggatttaaccggtaagatttacggctgtgccggctctggcgatactttctatgatgatgattattgccgcgccgtcaccgatttcagtaacgcgttgaagaaggctggggctactcagggtgccaaggacgtgttcgttaaccttgcaccagaagctgatgatgtaaaagccctggatgcatttactgaacaactcgttgctaaagttcagtaacctgactagtttgattgagtgaataacaaagaaacgcttcaagaattcatgactaattcttgaagcgtttcttttattaactgctatcgacacatcatcctgacgctgataccgaaaatcacaatcaccgtaatcacttttattcagtccttacgatttcgagcacgttgtttaatggcgtttcacacgccgaaatccgagccaactaccgaacatggtcaaccccaatagcactgttcccatcacatttgcacgacttggcgcttcaccagtttgcggtaaagccgatgtgccgagtttggccgttacaggctgaacagctaccgaagctgattcagtcggccgtgattcttgatgatgaccgccaacgatagtttgcgcgtgttgcagactagctgtgttggtcatctggctccgatgcgtccatgaagtgactactgatttagccccattagccgtcgtttgcatgccagaattacgatccgcaccctttccatgattcgtgccaaccgcgggtgttgcgtcatcaataactgcattggcatcaacgtcagccgcatcaccctccatctggtcagcatcattcgtaggtatttctgcttgatcatcaccatcgatacttccagtcgagccgccgttcacatcgtcattggtattggtagcgcctggctgttcagtattcgtatcgccatcgctcgccgcaacgaccgtgactgttgccacgcgagtgaaaatttgaccactcgcatccgtatactgataagtcacctggtaaacaccggcttgattagtatcgaccgtgccagttacgactaggtcagcaagcgacaattcaccgccattaacatccgtagccaagactaaattatcgcttggttgccacgactcaccgacagtaatagttgaatcatgaatctgtaaatcgctttgggattccgcctgttcgtcggcctcctcgataaccaccgttaccgtcatcgttgccgtcaccaactgaccagtcttgtcagtaaattgatacgtcaaccgatagtccccggctgtagtccaatctggcgttccaacgacctcaatggccgaccagtctaacgtttgaccatcactatcagtggcattctgaaaattgctttgaggttgccaagtactggttccctgcccatccgtatgcaccgttgcgtggttttgatataagttcaaactggcttggttttccttaacagttacagtaatcgtctgtgtctgactaccatacgtgtaagtaatctggtaatcacccgggaccatggtgttcacttcacctattaccgtcacatcgttaaagtcgatggcgtgaccgtctttatccgtcgccccgtcaaaaccgtcctgcgcatgccaagtgccaccagcgtgtaactctgtatcatggaccgtcaaacttgtctggtcagctttcacgatcaccaaagcagtgaccgtcttacccgcatacttgaaagtgacccggtaagtccccggctgactagtatttactcggtcacccgatagtttcacagcctggggattagccacatagagggcctgaacatcgactttttgaccaaattggtcggttaaactctcgatactgtccgtccagttccaatcatcgccaacttccagggtaatgtcgttggcatcgataactgcttggtttgcttcccagatgtaggttccaatcggcgtattttttcctgaatacagattcatcagttcagcactagttaaccgttgctggggattggctacatttatccagtaaccggtatattggtcattagcttcaatgtccattagcccaaccgactcgattttggctggcgtcaaatcagtatccggaccaagtgtaattttttgtagacgctcacatcccgcaaacatgtcgagattttgttcaacgcgatgcaaattaaaaccagatagatccacctcagttaaattggaacatcctgaaaatagcaaatgaatccaagtaacctgatctgttttgaactgagacccgaatttaacactggttaagttgtgcatgtccataaaccaagcagccatattttcaaggctatcagtcttccatttggataagtctagctccgacaaccccgttttgataaacaaaccgcctgcttcttttaggctttcaaagttcaaattctcgataccaataatacgagttaacttttcattgggaccaaacatgtagtccgcttcacttactcgacgagtgtcccaccctgaaatattgattgtcgttagttggctagtccctggagaattgaaaaacaggtaagacatatcagtcacatttcccacctgccagctgctcaaatctagctccttaacatgcgtattttctgaaaagaaatatcttaaatccgtcgcagaactaacatcaattttttcaagcccttcatagtgttcaacattcgtcaaattttcaaagaagcccccactatcacctataatgcgaattggctttgaaatcacaactttaactatttgtaacacccacgattttgattgccacggactatccccatagcaatcgtaaatttcgccaccgtccaacactaacacaccagaatccgcgtcaaaatgccatctaatgccatcggcgttgtacccagcaccccagatgccggccatcgagtcgtcgtcttccatatcatcgttgcgataaccatccgtgagatgtgggcgttctggatttcgaatcacgccagccaaatcaccgcttccccgctcattgatggtttccgttttatgctgcgacgacaagacttttgcagtactatccgtgtcaatatcttgcgactgctcgtcggcactaactggctgttcagaatcatcagttgtcgattggttcggatgcgtatcaagtgttgcagtatgttcgtctgacggaacgggggtctcactgtcaacttgatccgtgaccggtacactgacctgatcagaattcgcatgctcatcatcagattgattgacaatctcatcagtatactgttcttcagcggcctgcactttaattggttgagcttcagttaccagttcactcattgcggattcatccatggcgtcggttactggggattgctgctcagcgttaccttcagacaaagttgccactgccggttcagtcaatgcttctacgtgtgttgattcatctgctcgtcccgtcaccacattcatgttcaacgtaacgagcgtgattccagcgaacaaccacatcttaccactcttgtacatcttgtaccgtttcttcacttgttccattaatttctcactcctttattaattaaccttgccgacgtttaatgccgacgatgctggctaaaccagtcaccattaacatcatgagtcccagcaacccgaagcgattaactcgttcattagtttgcggtaactcaccagctactgacgctgaatgactgactggggccataaccacttccggttcagctgtatcaaccgtagcataccgtttaccatcaattctgccctcattgcgttcagtcgtgtccagtttcaatttatcacgaaacaccgtggtcacttgcttctctaaaccaccgttaaattctggtcgcactatcgtgtttgcttgttctctttgactgctggaaccagcgtttgcgcccgttaaaccactgttaggatcactagtatcagggtgttcagtagttcccggttgttctgattgttcaggaacttccggcagttctggttgatcaggtgtccctggcgctgacggttcccctggtatttcaggggtttcaggggtttcaggctgttcgggtgttcctggttcttccggtaactccggttcagctggttctcccggtaacggcgtttcaccattgccagcaccttcgactaccgtaatggtggctgtttgagtccactgcaggccattggcgttcgtgtattgatacgtgatttcataagtaccgggttgcgtcgtgtcaacgtcaccaatcacaactaagtccgctagtgttaatggccgtcccgtcgcatcactggcacttacgaagttgtctgccgcctgccagtggtcgccaactgtcaccgttgtatcttgaacaaccagttctgtcaggtcttcaacgtcagcctcttgttcagtcaccgtgacggtcgttgtcgccgtgactaactgtccggtcaagtcagtgaactgataaacgacctcatatgtccccggccgtgttaagtctggttctccaaacaccgtcacgttctgccattccactgaacggccatctgcatccgttgcactcgcaaaattatcccgtggacgccagaccgcacttcccgttgcgagatcaatttcaaccgcaacctcttgcgcatgcaagtttagttgactttgattagccacaaccgtgacaaccacggttgtttgccgacccgcataagttagtatcacgtgatacgaccctggctggctggtgtcaacaggctcaccgctaactgtcaccgcttgggggtctgtactgaacaagactcctggatcaactaactggccattttgatcaactagttgcgcaatattttgtgtccagtcccatttttgattcaagaagagcgtgctgtctttaccggtaatcacggtcgcagagacggtttcccagacaaacgtcgccgtgttagcgtggtttcccgaatattgcgccaggagttcagcactcgtgaacgtttgcgagctatcagctacgttgacccatttgccggtatatttgctattcttaggcacttccggtaaatcaactaagggttgcgtgccgtgttgactaaaatcaagtcccggaccaagtgtcaacgtttgcaaacttgtcaaaccagctagcatttgccagttttgttcaatattctgcatattgaaatgggacaagtcgagcacctttagtttggcatcatcattaaacaaactattgatttgagtgactttagcgacggtaaactgcgtaccgaattcgatacgctccaaatcggacatctgcgcaaaggcaccatcgatttcaaccaggctggctgaatcaaagctcgtcagattcaagtgacggacgcctgtgcgcgcaaacatgttggccatcgtcgttacactgcgcgtatcccagtcagtcaaaccgtcaatagttcgaagttggccgttgaactggaacatattttgcatgttggcgacattatgagtatcccagccactgagattgaggtatttaagttcagtacccatgaagttccccataaacatgttcaccattgtggtcacattgccgacttgccaatcactcaagtccagtcgctctagcgaggtattttctttgaacagagactgcatgttggtcacagcactggtatcaatcttttctaacccttcgtaacgcgtcacgctgtcaagattcgcaaacagactattcatgttagtaccggcaacaattttgtcagcaatcacgatacacttgatcatcggcgcccaagacttgcgacgccaaggattatccccataactgttatttaacgtgcccccgttcagcgttagcgtgcctgtactggcatcaaagtgccaatcaacgccaaagttaccagacatttcatcctcatccgccctagtcacagcacgagtatcaacgtgctgtgactccaccttaaggtcatctaccagctgatgctgctcaacttgttgcaagtcagcggcggatttacgttctgacgcgtcagcagtatcgagtaataactgttcactcgcttcaggctgttgttcactaacggtcgattctgcggcattactgaacagatcgtcagtccgtgctgcttcataactgttcgtcgcgggcgctaccgtatttagtccgttcactgctgccatcgaatcagcggctacctcactattgggcgcgccagatgtcccgttcaacgcagccgttgatgcagcggattgcggctcgtcattagtagctggctgtgcatcgattaccgtctgattagtaatcgaagcgttctcatcattagccacgtcaacgttatccgttttagaaaccgaacttgccagtgtttgattgctgctaccttgattttgaattaacacaccgttagtcgctacgacactcgtttcgctggtcgatgcagatgttggttcatccgcatgtgcggttaacagttgagtattcaacaataatagtgaagcgctcgcaaacaaccacatcttgccacttttatacattttataacatttcacttctgattcacggtaattgatagtaattccccatttcttcaaaaacaacctaactgacctaacgattaatctcattaaataaagtgttcttactatatttgattatcgtgtttaactagtacatcatttacggtttttaaatataccatggtaccctcataatgctcaactgattatcacaattctaattaacctgttatcattatgattaatccgcttgtttatcgcaaaaatataattatcaactccctatttctgcaatcgttttcatcgtggtgattcattaattctggtcgttttagtattcgaccaccactattcgttcaccatactgacagttgcatcatgcaccggtcagctgtcaccatggcgactgaccagtgtcttccagtaatccccggccatcaaaaaagccttgagcaatattactgctcaagacctggtttacccattctaatagcgtatttccctaatttgaatcgaaagactccccccgcgtaatcatgagctagtagatacgataattgtcactcggccccgagtcatttggatcgtcgtttcacaacgatttgtcgaatcgcattataaactagctcaacgatgacaaacagcaccgtgatacccacaatatcaattaaatacgaactaagtcgatagcccaccttgccgatccacaaatcatacggcccttgaatcagtaagaaatagatgactaacgtttcaaaaatcgtccgggtatgccgccaaaacgatcgccattgcattgatttcacgccccttcaagtggtgccaacatttgtaacgcctgtttgacctgactcactgctaattgactttgatcaccgacccggccgacgtgtccaaaggcaactgccgaccccgtcaactgactacagacactgttataacgaccaaacttgcccatcgccgttgccacgattggcacaactaattgctgccgtgcttgctcagttgccgccattaatgccaacaccgtctgtgcatcatgtccagccactgtcacccgcacgacatcagcaccagttgctgctaattcgtgataagtcgccaataaatcgtcagttgttgctgtcgtgacggtctggctcgcaattaaccgaatttcgttggcacgcatctgtttggtcaacgtcataaaatctggctgattgaccatggctaagtcaatatccacgccagccacgcttcgattattcactaatgtttgataagtttgataatattcggtcacttcagctggatcgtttgccagcccaaacatggcaattaatggaatcgtccccaaaacttgttgcaattgggccgctgtattgactaactccgcacggttatccaattcctgataaggatctaaccgccaaacaacaatttgtgccaccgaagttaaaatctgccccgctttacgcaagaggtcctcccgtgtggcccccgctaaaacaacaccaatcttaggcatccctgtcgctaacgttaactccccaactgtaacttctttcaagaccattcctgctttcattttcattcgaacaatgcgcgtccgttgccgttaaattttatctcctcttaacaatagcaaattttcgctgttttgacactcaaaattcattttttgacttaaaatttaaagcgcttttaatattaacttgttaatactggcatcgctttcagtttggccttacaattaagcatactttagctcacaaaggagttcaacatggaaaacgaaaaacaacttcgatggtccaacattgctttaattgcattcgtggcggtctggggcctaggtaacgttgtcaataactttgcgttacaagggctttcagtcgtcacttcttggattttaatcatgattatttattttattccctacaccttgattgtgggtcaactgggttcgacctttaaggatgctgaggggggcgtctcatcttggattcgagcaacgagtaccaagcgcctagcttactatgctgcctggacttattggatcgtgcacattccgtacttagcacaaaaaccccaagggattctaattgcattcagctggctgttccgcggtaatgggaacttcgtcaacacgacacctgcgttagtcgttcaagccatttgtttagtgctattcttattcttcctctggattgcttcattgggactaacgacactgaaacgcatcgggagtgttgctggtacggggatgttcatcatgtcgattttattcatcatcttggccgtatcagcaccgtttatgaccaaggcgactgttcagacacagaacatgttttcactcaagtcctacttacctaagtttgactttacctactttacgaccgtttcaatgttagtcttcgcggtcgggggatctgaaaagatttcgccgtacgttaataaaaccaaaaatccgggacgtgagtttccattaggcatgttagtgctcgcaggtatggtcgcaatctgtgccctgctgggttcatttgccatggggattctgtttaattccaaacacattcccgctgatttgatggccaacggtgcttactacgcgtttcaacgactaggtgccttctaccacgtgggcaatctgttcttgatcctctacgcaattgccaatgtgcttgcccaaatctccgccttagcgttctcaatcgatgcgccattgaagattttgcttggtgatgccgaccctgaatttattcccaaaaaattaagtaaaatgaacaagaaggatgtgcccgtcaacggttacatcttaactggggttttggtcagcattctcattatcattcctgcattagggattggaaacatgaatgaactctttaattggttattgaacttaaattcggtcgtaatgccgatgcgctatctgtgggtctttctagcttacatgctactcaacaagcacttaaaggaattcaagagtgattacaagttcctgaaaaacccagtcgctggccgtttggtcggtgcttggtgcttcctgtttacagcatttgcttgtatcctcggaatggttccaaagacttcctacgctagcaatcctagcagttggctcttccaactgactttaaatattctaacgccaattatctttgttgccttagggatgattttgccgatgattgctcgtcgtcatcgcactaaaaccgcttagtgcgtcaccgatctttgcgcccgcatcgtcgctctacgcctgcggactcactgacttttttgtaacgttgatcgataatctattcgccaccgctgacagcgcaaaaaactgtcagcggtggttttggtattacaaaccgttgctagtaggcatgcgtgttcacgtaacatttcagtcaataatttgcggctcacaatcttacactttttacacgtttagcggtatgatgcttagtgaatatagtcaatccaaatttaccaagcagtcgctcttcaaggaggttcttatttatggctaccgtcgacgctctcgacatgtttttgaccgattatgccaatatctctcgttacctgaatactcgcttaaattcactactggccacgcaacatcttacctttgacgcttttttaatcatgcatgaaataggtcaaagcccccagccactattattaatggagatcgcacatcagcaccatgtctcacgcagcgcaatctcacgccaaatcggagtcctcctcaaacatcgatacattgagcaacaggctaatgccactgatcgccgccaaaaaggactttccttaacggctaccggccgtcacctagatcagcaactaatggccaccatgcacaaaacggttcaccagtggacgactcaattgggcccgcaacgggtgaagaccctgctaggcatcttcactgactttaacgagcaaattatcaataatgaggttcccgccagcgattaataaccagccatcctcagcttcatcattcggcattagtcgtaacgtgccccattttagtaagctgatttttattcgtcgccatttcaagttacggcttttaaaggccttaatcaaaaaacggcgccatggacgctagtgattctagcgtccatggcgtcgttaattttcagttacaatcaaagcagcttacactacggtacgttcgtccgcgacttggccggctctgccgctagtcatctgcatgcacgtcaaaggcatgcaacaactgttctgaaacccctggcgcatctgggtcgtggtgacctttaccggtatctaaagctcgtaattgggccatctcagtcgaagttaattcaaagtcgaagatatcccgattactcttgatccgtgcactgtgcactgatttaggaaagacgatcacgccttcttgatgttcaaatctaagaatgatttgaccagcatccttatgatacttaatagccaattgttgaatgattggttctttgaataatgcttgattgccctgacccaagggcgcccaagcttctaatttaacatcttgtgccgcgagtaattggcgcaagggttgttgctgaaagtacgggttaaattcaacctgattgactgcagggatcgtttcaaattgtggcacaaatttttgccacaacgttggtgtcatattggaaacaccgatcgactttaatttcccggccttttgggctgcttccattgcttgccatgcacccggaacatcgccataaggttgatgaattaagtacaagtcaatatagtctagtcgcaacttagttaacgaacgatcgatggcgcgactggctgcgtcaaagccgtagtcttggagccaaagtttactcgtcacccagatttggtcccgtggaatcgcgcggccatcatttagcgtaatagttggtgtttttgtcattaataatcgctccttaacttattcgtgtaattgtcgtaaactagcgccaaaaatctgttcaattgtcacaggatcacgatgatcaaagaactgactgacgccctgatcaagttcggccattgctgacatttctgcagctgttaattcaaaatcaaaaacagcgatattctcagccatacgttcaggatgcactgattttggaatcaccgtaatcccgcgttgcaacagccaacgtaagatgacttgtccggtcgtcttaccatgggcctgtgcgatagtttgaatacttggattactgaaaatcgcatgcttaccttctgcaaacggtgcccaagcttcaacccgtacgtgttcatcttgattaaagcggacctcgtctgcttgctggtaccatggattgacctcgatttgattgacagctggttgcacggacatggtcagttccaagttctttagctgatccgcataaaaattggaaacaccaattgcgcgaatcttaccagcatggtaagcctcttctaaagcacgccaagcacccatcacatcgccataaggttggtgcaaaagatacaagtccaagtagtctacgcctaaacgttgtaatgacgcatcaataccttgctttgcacgttcataggtgaattctgagacccacagcttggaagtgacaaagagttcatcacgtctaagaccactcttttgaattgcccgccccactgcggtttcattttggtatgccgttgccgtatcaattaaacggtaaccagcctttaaggccgcggtcaccgctgcttcacattcattcaggtcagggacttggaacacgccgaatcccaattggggcataaccacaccattgtttaatttcgttgttggaaccatcacgcatcaacctttcactatttgattacaataacaagcatacccgcaaacctaatacttgaaaattactacttattcatactagtatacatatagtgcatactagtaacggaggttcctgatgattgaaaattatttattagaagagctgatcacattcgcccacgagcacacgctggctaagaccgcggccgcattaaacgtgacgcaaccaaccatcactcgcggcatgcagaaattggaaacaatgctcgctgttcgcttatttgatcgtcaacccaatcgaattacactgacgcccactggccagttagccgctcaggaagctgaacaattattgacacaacaacggacttttgtaaccaaaatacaaaactacgagcaaagcttagtcacacgtaccgtcgaaaccaccctacctggtccacttgccttactcacccatctcaaaacggtattacctaattcgctgcgagtaaggcaaccactgattgccgacgaccaaatcactgagcatctcattaaccgccaggcaagtttcattttctctaatcaggaaattctgacggccggcattgaatctcgcttcatcggtactgaaaatctcgtggtccatttacagcgattcatgtaccgtgcgaaccaacctagcatcacgttcgccgaacttaagggaattagcttcgtggttctaagcgcaatcggtatttggaaagatattattcagcaggccatcccagatgctaaattcttataccaaccccaacgcacggcctttacagaaatcactaaatactctgattttccgtacttcagtactaactttaccgcattggcgcctcaccagctggatagccaagccgatgatgacaatcgagtcgctatcccgattagcgatactcgtgctcacatgccaatctatgtcaattatcttgttagcaatcgacaatcattaatgcccctattcaagcaatttgaagccgcgtggccagccaatctcaagcatacttccacgtcctagcagctaacataattaagccgttcggtctaaaactgcaaaatgaagtgttacgctcaatcacagggggtatatactggttgaagctcgccctcccagttcttgatagcaaaagaggtccacacgctcgcttagctaatctaatgcgagcgtgtggacctcttttcatattaagtttggttcgttcaagtcttaatcttaaacatggaccctaatgtgatgattagttgcagaaaaaacagttaaacaagcattccacgccaatcatcttctaacagcaagccgtttagcagatttgaactgccgacctcttccttaccatggaagtgctctacctgctgagctaaaacggcgttaattgaccctatccagtataccaaaagcatgtttaaattcaaactgtactggttgacattcaacgtaaaaaaaaggaaccgaattaacgattccttaggttgcatggcaacgtcctaccctcgcagggagcgatcccccaactactctcggcgctaagaagcttaacttctgtgttcgacatgggaacaggtgtatccttctcgccatcgtcaccacactattgagaaacttgtgctctcaaaactagctaatatcaaatatcttcatatgaaccggaacaccaattacttggttaagtcctcgaccgattagtattagtccgcttcatgcgtcaccgcactgccacttctaacctatctacctgatcatctttcaggggtcttacttccataaaggaatgggaaatctcatctcgaggtgtgtttcacacttagatgctttcagcgtttatcacatccatacgtagctacccagcgatgcgcctggcggcacaactggtacaccagaggtatgtccatcccggtcctctcgtactaaggacaggtcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggtaccaccggatcactaagcccgactttcgtccctgctcgacctgtctgtctcgcagtcaagctcccttgtgcctttacactctgcgaatgatttccaaccattctgagggaacctttgggcgcctccgttactttttaggaggcgaccgccccagtcaaactgcccacctgacactgtctcccaccacgattagtggtgcgggttagagtggtcatacagcgagggtagtatcccaccaacgcctccaccgaaactagcgttccggtttctatggctcctacctatcctgtacaagctgtacaaacactcaatatcaagctacagtaaagctccatggggtctttccgtcctgtcgcgggtagtccgcatcttcacggacaatataatttcaccgagtctctcgttgagacagtgcccagatcgttacgcctttcgtgcgggtcggaacttacccgacaaggaatttcgctaccttaggaccgttatagttacggccgccgtttactggggcttcaattctgagcttcgccgaagctaacccatccttttaaccttccagcaccgggcaggcgtcagcccctatacgtcatcttacgattttgcagagacctgtgtttttgataaacagtcgcctgggcctattcactgcggctgatcttgcgatcagcaccccttctcccgaagttacggggtcattttgccgagttccttaacgagagttcactcgctcaccttaggattctctcctcgactacctgtgtcggtttgcggtacgggtagttaagtactcactagaagcttttctcggcagtgtgacatcagacgcttcgctactaaatttcgctccccatcacagcttgtccttaaagtgaaaagcatttgactcttcacaagacttactgcttggacattctaatccaacagaatgcacatcttagcctcctgcgtccctccattgctcaaacgcacttaactagtacaggaatctcaacctgttatccatcgtctacgcctctcggcctcgacttaggtcccgactaaccctgggaggacgagccttccccaggaaaccttagtcattcggtggataggattctcacctatctttcgctactcataccggcattctcacttctaagcgctccacaagtcctcacgatcttgcttcaccgcccttagaacgctctcctatcacgcgacctaatggtcgcatccatggtttcggtagtatgcttagccccggtacattttcggcgcaggatcactcgactagtgagctattacgcactctttaaatggtggctgcttctgagccaacatcctagttgtctatgcaactccacatccttttccacttagcatacatttagggaccttaactgatggtctgggctgttcccctttcgacggtggatcttatcactcatcgtctgactcccggatatgaatcaatggcattcggagtttatctgaattcagtaacccaagacgggcccctagtccaaatagtgctctacctccatgatcctaattccgaggctagccctaaagctatttcggagagaaccagctatctccaagttcgtttggaatttcaccgctatccacacctcatcccagcaattttcaacttacacgggttcggtcctccagtgcgttttaccgcaccttcaacctggacatggataggtcacctggtttcgggtctataacctcgtactcaaaacgcccatttcagactcgctttcgctacggctccgactttttagtcttaaccttgcacgggatcataactcgccggttcattctacaaaaggcacgccatcacgcattaacgcgctctgacttattgtaggcacatggtttcaggaactatttcactcccctcccggggtgcttttcacctttccctcacggtactggttcactatcggtcactaggtagtatttagccttgggagatggtcctcccggattccgacggaatttcacgtgttccgccgtactcaggatcctgaactgagagaatttgatttaatctactgggctatcaccatctatggcggattttcccaaatccttcgactatcaagttctttggtaactcaaatgttcagtcctacaaccccaaagtgcaagcactttggtttgggctgttccccgttcgctcgccgctacttagggaatcgaaatttctttatattcctgctgctaatgagatgtttcagttcacagcgtttacctccaactagactatgaattcatctagtggtaacagttgattaaaactgctgggttgccccattcggaaatctccggattatagcttacgtacagctccccgaagcatatcggtgttagtcccgtccttcatcggctcctagtgccaaggcattcaccatgcgcccttgttaacttaacctcatttacctaacggtaaatgcgattaatgagtttagcgataattaaacttcaataaaaaactcaaaaaacgcggtgttctcggtttcattatgaaaaaatatatttgatattatctagttttcaaagaacaagttttgagagttaaatctctcaaaactaaacaaagtttcgacgcgtgtgtaggtttccgtaatattccttagaaaggaggtgatccagccgcaggttctcctacggctaccttgttacgacttcaccctaatcatctgtcccaccttaggcggctggttcccaaaaggttaccccaccgactttgggtgttacaaactctcatggtgtgacgggcggtgtgtacaaggcccgggaacgtattcaccgcggcatgctgatccgcgattactagcgattccgacttcatgtaggcgagttgcagcctacaatccgaactgagaatggctttaagagattagcttactctcgcgagttcgcaactcgttgtaccatccattgtagcacgtgtgtagcccaggtcataaggggcatgatgatttgacgtcatccccaccttcctccggtttgtcaccggcagtctcaccagagtgcccaacttaatgctggcaactgataataagggttgcgctcgttgcgggacttaacccaacatctcacgacacgagctgacgacaaccatgcaccacctgtatccatgtccccgaagggaacgtctaatctcttagatttgcatagtatgtcaagacctggtaaggttcttcgcgtagcttcgaattaaaccacatgctccaccgcttgtgcgggcccccgtcaattcctttgagtttcagccttgcggccgtactccccaggcggaatgcttaatgcgttagctgcagcactgaagggcggaaaccctccaacacttagcattcatcgtttacggtatggactaccagggtatctaatcctgtttgctacccatactttcgagcctcagcgtcagttacagaccagacagccgccttcgccactggtgttcttccatatatctacgcatttcaccgctacacatggagttccactgtcctcttctgcactcaagtttcccagtttccgatgcacttcttcggttgagccgaaggctttcacatcagacttaaaaaaccgcctgcgctcgctttacgcccaataaatccggacaacgcttgccacctacgtattaccgcggctgctggcacgtagttagccgtggctttctggttaaataccgtcaatacctgaacagttactctcagatatgttcttctttaacaacagagttttacgagccgaaacccttcttcactcacgcggcgttgctccatcagactttcgtccattgtggaagattccctactgctgcctcccgtaggagtttgggccgtgtctcagtcccaatgtggccgattaccctctcaggtcggctacgtatcattgccatggtgagccgttacctcaccatctagctaatacgccgcgggaccatccaaaagtgatagccgaagccatctttcaaactcggaccatgcggtccaagttgttatgcggtattagcatctgtttccaggtgttatcccccgcttctgggcaggtttcccacgtgttactcaccagttcgccactcactcaaatgtaaatcatgatgcaagcaccaatcaataccagagttcgttcgacttgcatgtattaggcacgccgccagcgttcgtcctgagccaggatcaaactctcaaattaatgatgagttctaaaaagctcatttaatgttgtactaaaatttatttgctagcgaattgacttcgcaaatgttttgctcttgattcaaaatcaagagaccctacacatttgattcgtcgaaactttgttcagttttcaaagatctaattccgtgtgttaatcgcttaacacaacttaattatcataacatcttaatcaatatcttgtcaacaactttttttaagaagtaacttgattaatttgtcgtggttgccgttgcgacaacagaaactatcttaccaattactgaagaagttgtcaacaactaatttcaataattatttggtggtgagatgcatctgccgtagcagcaacgtttactaatataccagccagttatgaaactgtcaacaattaatccaatgttttttcacttttatgaaaagaacggcacaaaactgtcgtcaattacacaattactacattatatgtcagcgattaacatcattgtgagatggcactatgttttccaattaaggattccctttagacagcaaaaaagcgcccgtaaaagcacgacgaacgcttgtcttaagccagcacatttaattttaaaaatttaaatgacgtttaacgattggtcgaattcctgcaacaattgggaatgccaagataccaccaaccacagcttgaactaaattagtcggtacaccaaccaatccagttgccatcgtatacaacagcgaatctgacaaaaagtatccgaccaccatcaccactaccgcagtaattatcgctgcaatctgtcgaccatgtgatttgctagcaccaagatatcctgctattccgccctctaaaccatgaacgagtagtgagaaaaacatatactgtggataccctagcaataaatctagtaatagtccgctagcaccgccaacaatgaccccaccacgccagccaaaaatcagtgctgcaataaagatttccgcatcacataagttaatataaccgtgtgtcatcgggattgggatatggaaaaagatagaaataacaacattaagtgcgatcaacatccccaggattgcaatcgtccgtgtattaaatttaacccccaccaaaactttcatctcctcaattgattttcatctggcaatgatcacacattattaatgtgacctaagtaaattttacaccagttcttacttgtaataataataaaaagactgggccacaacgggtccagtccacctgctaaattaacttacttaacatgtgccaagaagtaacgtttcttaccacgacgtacaatgacaaatttaccattaaaggctgcggacggatcaatctcggcctcgacatccgtcaccttttcaccattgattcgaatcgcaccgtttttaatatcttcacgtgcttgacgccgagaaggttcgaatttcgtagcatcaaccagccacaagacaatgttttgcttttcagctgagacgtctgctgatggcacacccttgaaaccttgttcaatttcgtccgccgttaaactttgaacatcaccagtaaacaacgccttagtaatattttcagcttcaactaccgcctgcttgccatgaacaaattccgtgacttcttcagctaagcgccgttgtgcttcccgtttttcaggtgcagtcttcaccgtttcggccaatcgatcgatttcttcatgacttaagaacgtgaagtacttgaggtatttgacgacgtctcgatcatcctggttgatccagaattgatagaattcatacggtgatgtccgttcagggtttaaccatacggccccaccagcagtcttaccaaacttagtcccatccgccttcaacaataatggaattgttaatccgtaagccttagcgtcattgccttctaagcggtggatcaaatcggtccccgcggtgatattgccccactgatcagccccaccaatctggagttgcacgtgttcagcacggtacaagtgtaagaagtcaactgattgtaagatttggtatgtgaattcagtgtatgaaatgcccacttccaaccggcttgcaacaacttccttgttcagcatcgtgttcacactgaacaacttaccataatcgcgtaagaaatctagtaatgaaatttttgataaccaatcgtagttattcacaatcgaaaagttttcgtcatgaccaaacaacttgtacatctgagcacttaagccatcctgattatgcttcacttgatccatggtctgtaacttacgttctgagttcttaccagatggatcaccgatagcacccgtcccaccaccaactacaacgtagggatgatgaccagccaattggaatcgtttgagaatcatgaaaggaatcaaatgcccaatatgcatactatccccggttggatcaatcccacagtatagtgagactgattggttttcggtaagttcctttaacccggcctcatccgtttgttggttaatggcaccacgccattttaaatcatcgataatgttcatgttagtcctcctcgttattgtcgctggacaaaaaaactcgcccctgtcatcaaaacagggacgagttttccgcgttaccacccaagttatcaccaaatgtgatcgctcattgattagtaacggatatcatccggccaatggcagttcacgttatgtaattcatctttgactacagctcggttcgcaccacccaccgagtcgctagactgttgggtcaacgactactaattaacgatcactactttttaattattacctaacatcataagcactccactgccaaaagtcaatcctattttcggtcaaaacatcgcattaaacccactaatctaaccatagtgtctggcttgtgaatgcggttgacgtcgacacagtgatataaccagactactggcactcattcattgagctcccaggtaaaaacttaatttttagcatccgccgcaattttgataacggtattggcttgctggccttgaaccttagcaacctgtttgccattttgccattgaactgagtttgcctgtccgttttgtggggtatcgtacacggtaacggcaccactcgtgacatttttactcgtcaaatcttgcttttgaatctgattattgacctgattagcaaacttggttggattaccagcaacgtcctgtgtattggcaatcgttgtcactgaccaactacccgtgttccaatgaacatacactttgcccatcgtcccttgaaccgttgccgctgtacctgaattaagtgtcgtacgctgaccctgcgtattcgctaagtaatcgacttggctgctggcatcacttttcgcattgtagttcgtctgttgatacgtcgcagtcgtcgaactagtcccagctttggcgtacttcacccggtagtttcccttggtcccacttgcactgatggccttgactgtttgattggttgccttgacggtcgtaggcgctgccgtctgactaaccaaactaacactgtctgaagccgcgtgtaatacattcgttactgaaggtacggcaacaattccgaccaccaacatcccagttgcagtggcgattcctaattgaattttgcgcttaaagttcatgaaaaatatcctcctaatttctacaacaaatgaccgattttacttaaccataattaccttttctaccatgataatgagaactgagcgacagccatgcaatcagctaagtcctcgcttgtcccgagaagtgttatgtacgggacgtatttgtgttcgttgccgacgtggtgcacgacgaatcgtcgaccctcgccgctgcaccgttactcgtagtgcgcggcggcgggattgcctgtttttcgttactcgctgcctcagtgacggttgacgtcgcgtaagtcgctgccgcgttcgcccttttgaacgagtcaccggttttgttcgaatactcttaccgggccgccgaagtttagttgctttggacgtattcagtttaaactgtgttcctgtacgtcgcgtcgctttaagttttatcactttgggctgagtcgctcggcgtcgaatggcgcgatgctgagttattttgccatgatggctgttaacactgatcgtttgcaatgaccgccgtttgacgcgcgccacggtctgcgaacgcgacttattgcttaccactttctgctgcaccggccgagtcttcacagctggctgaactgctggcctcttaatggcgacaactgcttggcccgcccgtccatgctgttgattgtgggccggcatagtcaaatggcgatcgtgcacaactttcagtcttggttgagctttaatcgcaacaccgggtgcgccacgggtcgtccccaaccaccacgaaacgggatgaacactaataatgacccgactattatcaaccggtgccgctagcccagctaaatgatagcgattggtatactgccataatgccgccgaaatgattggtgggttaggcgttagcgcaccaatccactgggcatcaaaccgttgccgcgcttggttggcatacgtcagtgcgaacgaagcatacgaatagaagatcagttttttgttagtcaatgcgcgcatttcacgataccaagccgcaactgccgcattagttgatcctgaacgtaccgtattaacttcaaaatccaaagcataaaaacgcgcagctttattggagcgcgcataaaacgcttgggcttcacggcgcgcgctagtggcattcgtaaattgcgaaaaatcatactcaccaaatggaatcccataacgaacatataatgccgtattattcgctgcgtcccggtcaacataatttaaaccatactgacgacgattgatcacaaatagcacttgcgacttcatcgcctgcacctgacttgggctgagctgtccttgccactcggaaatatcgaccaccgcgtgtccctgtgcttgaaccgtaatttgcatgccaagtgtggcgaccaccgccgttccaactaaccaactgagccttttaatccccatcatgcggtccctctccccatactgtgctccgcaattaaaaaaattatcatcataagttgttggtgattcccacaatcaccaacaactaaactatcaaggacagtttatgacatacccataactttaacattcttatactaccaataataggccatttttaatgggctggggcgtcaattcgatttcaattcagttacagcttgttaacaaagcgtcgcccctttatggttaatattatgaacaactctggaaaggctgatatttgaattacagtttggttacaatcatgatattgttagcagtttctcacccgctttccggtgcccgaactacccataccacgggatattacaaccgtttcattcgaaaataccgccacaaaaaaaagcaactaatcctcatcaagattttggctcatcttgaccaagattagttgcttaaactaattggttcacaatagcatgttgttaactaactaatgtggtaacgtcagaacaatggcttgcttgcccatctgattgtaagcagcctcaaaattcttccagctgactgcctgctgtttttctccgtacggattgttaatataaatcaactttttagtccggttaaagccaacaatgaccacactgtgcatatcataagtcactttaacggagccctgtggtgtctgccaagtttgcatcgtgctgaccggtgcaaacgaagccgtcgtaattgtccaaacgggccgtccttgttctaactgttcaatcacagtatcaaagtttgcccccgttaagtccttcacctgactagtctcagttttcgccaatttatagattggcttatgatagacacctaacccaggatcgttaccagtaatatccccaacaaacccatactctggattcccatgttcgccgtcactataagtgagtggcacactcgtaatctttgccgctaattcatttttagtgacattgatatgcgcgtaattcatcaacatcgttaacgatgtgacttcacaaccattgtataaacgtggtgttgtcatttgattcactagcgggacgtccaacttgacctgattgaccgacttgggcttcgtttgggaactagacttagctgcatccgtttgtttagttgtaaacgatgcatcaatccagtcagaaacttgtgtgcttgtaaatccaatgacccccaaaagcaccatggcaattatgatcagcgtccaggaccggcgccgtttccgtaaatgtcttggcatttgttaccatccgtttctcttttaatttgattgactactttactaacatactatgtagtatcataccatggacgaatcaataatacacctttacaatcttaaaaaaaagacttgtataatcagccgtaagtcaatgctgacaaggattaaggttagcctggttaatcattaagcaacacactgctttaatcagtttattgatatattagtaaccttattatcaatttgttgaattagccctgaccgttacttagattataattgagattgtctggccgaggctggcttttcccaaaatggccttgaatattcgttatttgccgatgaagccaactttcctaattctgggcaccttctttattttatgaagcaccgagtccttgttttcaaaacagcattaaattggccccggcaaatccgttgcgtccttagattatctgtcatccgtttcaagcctagtggcatccaaagatttggcttctaatcagctttagaaaattttatgttgattaaagcgctttctttattacaatagtagtaaaagcagttaaatcttatggttaattgtgaaaggacctgaccggcatggctaattctgaagaccaaatggataaacacttacaatccgcaatattcggggcccccgtactacatccggatgaacaacaccgtaaccttggcacgtttcacgaacgaatcgatgtgggcattactttcacccaagcactcatgcgtgactactcaaccgaactaaaaagtgaaatggcggcccatcctgattaccagctactcctacatggcttgctagatgaagacatcctgaatcgctacgttaaactagccaaccagcagcacatcaggtttgcgattcgaaatgacctcatgtaccagcacacacctacgagcctcgccatcgccctagtcgccaactgtgccatcacgccaccgacaatcgatatcgatgaacgttttcccgttccgccacttaacacaactaccgattggtcgcacgacgtcctcatcgatcacattcaccgtcatctggaacgcaatcgtcaactcttcagcatcaaacaccacttaatctaaccggtgtcttactttgacatctattgtgcgtgttggcgtgaattatggttaaaacggactgttttttaaatcaaaagtaaccagcttaggcccgctgaaaaaaagtcgagtaagcgtaaaattgcttagttggcgcgtcctagaccggcttccagtcgggatagtgttcgaatggcggacatgtgcggacccaacttttggtgaattcgtcattgtttttcataaacaataactttgtcaatcaactgtcagactgaaagtgatattgagatagctcactaatcctgaattggtgtagtaagatgtaatctctcgacaaagtgctaatgcacctaacattttgtttgaagttccagtatcaaaatagccaacgatagattgtgctaagttcggtggtcgttcatcagccattcgagcggcttcccggctggaggggctgggggacaatgctcagtagccaaattattcttagtcggaagtgatttccttccggcttagaataagactcgtatttgagatgacgcgggttgggcgttagctcaaatcgacgtcggctgcgttccagcaattggcacccagccccggaggtcggcataggacgcgcaccggctgacggaaaacaatccagttaaacagtccgttttaaccatatttaatgccaatctctcaaatcgatgcatttatacacaaagccaccaacttaaaatgatcagctttcactgattgtcctaagttggtggcttttactttatcaatcaaaagacttaattgacttcaccattggcccactagttaaaataattgcatcacgctaattacgattggtggcactagcaaggctggtaataggttcaacgtactgaattgcttgattttcaacatgcctaagccggatgctagaatcaagataccaccaacaatggtaatttcattcagtaacgctgcactcaatgcacctttcaaaattaatgctaaaacatacaggctcccctgccaacaaaacaagacgcccgccgcaatcgcgatgccaaatccgaaagtggatgctaatacgatcgacgtgatgccatctaacatgccattcgtaaacaaaaaggtgtaatcatgctttaaggctgcctcaatcggccccaaaatcgataacgatccaatacagtacagtaacaccgcagtcgctaggccttccgctaagttgccacccgccaaacggcccacccagcggtcaaaatgcccttgaatatccaaagcttgaccaattaatccaccaatcgccaagctcacaataaaaagcaccgggtacttactctgcggcatccgttgcacgaccgcattaatgccgatgacacaagccgctagccctagtgcttgtaataatatcgcatggtaagctggcttgattccttttttaaagatactgccgaccaagcaaccagctaaaatcatactcgtattaaaaatcgtcccaatcatatcgccactcctaatcaatagcttaatctttagcgcttgtttcaatttaaaataattaattatcatttagtataaagtctaaagttacttgagggtcaagccttgattggtaattgtatctgcgtcaccgactgtgcaacctgatctgtaatcccataatcaatcagtgctgtctcaatagctgttcccgccacgtgccagccgtgagcacgacaatccgctaacaattgtcgatactgcatcggggcatccaaatgagtgccgtgaaaaatccgctgcgcatagccaccagccgccaagtgttcttgatggggtggcaccgtatcacccggttcaaataataaacaaattcccgcatagcggtcaaaatgtccggcttggatggcttgctggtcgagcatcagcgcaaccttgccgagaaagatttcgttcgtggcgccggtctgtgcgcgtagcttagcaataacaagttcaatatcatcttgagggcgataaggctgacgtaaagccaccatcgctctttcaggtaacgtcacgcattcagtcacatcaaaattggcactttgggccgttttaatctgggccaagcgtgtattgatccgttgttgtaccgccgttaacaatcgcaattgcgcctcaacctgctgctgttgggtcgttaacatactcgtcagcttgaacagttcacgggccgcaaaaaaatcggcaatcgtagctaatggtaagccgagtgctcgcaaatatctaatggtactcaaccgttcgaactgaggcgtcccataatatcggtagtgactatgcggattgactcgtgccggcgtcaataacccaatctcgtcataatagcgtaaagtcgccactgggatatcaaataactgtgcgagttgcccaatcgaaaaatcagttgtcatccgatcaccctcctcccctataggtcttatcataacttaatcgctgaagtaattgctgtaaccagaataagatatcataaaaaagttgcatttcagaaattaatttctgaaatgcaactttttggcctatcaatcatcagtgatcatcgccatcgcattattaatgcagaactaactgacagagctgttagcaattatttcgtaattgcgcgcgcatgccccgcccgaatctcagctaaatactgatcacttttggccgtatcaaattcatgttctgacttaccgataatcaccgcagctaatgaattgccgaccacgttaaccacggttcgtcccatgtcaaccagccggtcgattcccgcaataaaagcgagtccttgtactggcacgccaatcgttgaaatcgtcgccaataagacaacaaacgaagcccctggcacaccagcaatcccctttgacgtaatcataagtacaatcaataaagtgatctgctggctgagggacaggtgaatcccataagcctgagctaagaaaagcgccgctaacgattgataaattgcggagccatccaagttaaacgtatacccagttgggatcacaaatgagacaatcccttcactaacaccgtatttccccatcttatcgataatgcggggcagggccgcttcagaactcgccgttgaaaaaccaagcaccatttcatcacgaatgacccgtagtaggtgccaaatatttaaaccgaataacttaccaacaatgcccatcacaaccacaataaagattgccatggtaatataagcaagaataatgaaatagcctaacggggccagcgccttcaagcccatttcagcgaccgtgaccccaattaaggcacagacgccaatcggagccgtgtgcatgacccagttcgtcactttgaacatagcttcggcgacagcgttcataaagtccagaatgattttgccttgttcgccaatagccgccgtccctaaaccaaagaaaacggcaaaaaagatgactggaatcatgtcaccagctgacaatgatttaaagacgttagtcgggataatgcccatgaccgtcgaccaaataccattgtgtgagaccgtcttagcggtttgcacatactgactaatattcgacgcatgtagttgatgaatatcgatatagtcaccaggatgaaaaatgttacccattaacaaccctaaggcgatcgcaatcgtcgtcatgatttcgaaatagataatggttttaccaccaatccgacctaactttttgaggtcgcccatattagcaatcccggtaatcagacatgccaccacgattggtaaaacgatcatttgaatcagactgatgaacatcgtcccgatgttttgcatcgcagtaattgccgttttattgccataaaagacgacccctaatacaattccaagcactagcccaattaagatctgccagcccaagctcaatcggaactggcgataccgcttcatctttccctgcttttccaagctacttccgccccattctcatttatggatgtttttatgaaatattgcacacaatattaatattttagcacattttcagtcaatatgagaattaaattaaaaaatcaatcattaaaatcaaatggtcccattgtaatagacgttaatctcagttgctttcctcataatcacgtgattgtcgcggtgaatcactatttccgttaccatcagaatccgaacattaaccaaaatagcgacaattaaaactagcttggttagcagttgtaatcattcctaaccaagctagttttttaagcaaaaactttattcaacggttgcgattacgacacttcatcatgtcgtcactcactaaccgatttaaaccgctatttggaacgggtcatccggtcatagacagcggcactaacccaatcagcggtccacatccataaaacatgcccaatggcttctgacacgtgttcggtcattggttgatccttcgcagcgggaacggttcccagtgctggcaagataccatggtgaaatgctgtccagatacctaacccatacaacgcgctgctgccaccttttgcccgggggtgcttgcgagcccataaactataggccacagcaaaggtcgttgagaatccgaaatgcatgacatagctgacacctggtaaatcatgaccagaatatgaatacgttgcatgcgtaacgctggcgggaatcccaatttgttgcaataattgttgtgggggattcgtttgatcccgctgtggcgttcgtggcggtaggatattctcccaccctaacttaactaaaccagaaatcacaccaccagtcacaccagcaataactgcggcccgatgattgaactgcttgttcaccattaataattacctgcctctctattcaataaattaatcataccagccttggtacccatttcgaaataatttagcctggtaattaaataaaaaatttgatttacaaaaatgaacgtgatacgattaccacattgatttatcacttgataaatgaaattaaaagggaggaattgacatgtatttaggcttaaaagaaatggcccacgaaaaactcagatatgggctacttagcggggttttgctactaattgccctcgtcgtctttatgttagcgggccttgctaacgggttatccaatggtaatcgtcaggctgttgaccagtggcatgctcaaacagtttatttgaacgaagatgcgaatcagacactgtcagcatcccaattaaaactagcagaccaagatcgaatcaaaggtcaggacgtcgcacccttagctagtctgtccggtactttacgaactgccagtaatggtcaaaagactaacgctagcgcttttgggaccactcgcgatagttttctgatgccaaaagtcatctcaggacaccgaatcaacggcaagaatcaattattgatttccgcgggattaaaagacaaaggctatcggattggtcagaaagttcgcattgggaccactgatcaaaaggtaacgatcgtcggtactttcaaagctagtacctatagtattgcgccaacggtctacacggacgttgccacgctcaatcgtctcaaaggtaatcccatcaccagtggcgatcaacaaccggtcaacgcctttgtgactaaaaagagtcatttcaagactcaacatcatggcaacatgcaacgtttatcaattgccacgtttattgaaaaattaccaggatacagcgctgagcagttgacactcaacacgatgatttacttcttgttcgcaattgccctagccgtgattggaattttcatgttcgttctgacccttcaaaaacaagccttgttcggggtcttaaaagtacaaggtattggtaccaaacacatcttggctgccctactcacccaaagtgtcgtcatggcaatcattggtatcggcatcggccttctaattacgttaggcctcgcgcaaatcatgcccgccggattaccattcgccattgactggccacaatttggtatttatagtgtggctctcttgttagctgcagtcgtcggtgccttactctcatggcggactgtcgccaagattgaccccgtcgttgccattggataaggaggatgatatcaatgagtcaaccagttttagccttacaaaatattaataaacaatttggtcacggtcataccgctgttaacgctttgactgatgccaatttcgaagtcagtgctggccaattcgtcgcgattatcggcccctctggctcaggtaaatccacctttttgacgattgctgccggtttacaaacgccaacaagtggtcaagttattctgaacggacaaccactatcgaatcaaacggaaaaacagcgcttagcctaccgtttcaatgaaattggctttatcttgcagagttccaatctaattccattcctgacggttcgtgaacagttcaagctcgtcgataaaatggcccggcgcaaatttgatcaagcaggcaccgatggattactagcagagttagcccttactgaagttcgggatgcctacccaagtgacctctccggtggtgaacgccaacgtgttgccatcgcccgtgctctttacaatgatccaagcgtcattctcgcagatgaaccgaccgccagcctggacacgccccgctccatcgacgtcgtcaagcgcctcgccaacgaagctcatcagcaccaaaaggccatcgtaatggtgacccatgaccaacggctgattgatgactgtgacgtggtctatcaaattgaagatggtaagatgagtcgccgcgactcgtagtgccactgaccactgcactttaacctcataacagtaaaaatgacctcgccaggaatgttcctgtgaggtcatttttactgttcatatttacacgactcatcagacactacgaatcgaaaactagaatttgccaagctcaaagacagcctgcttcggcccgctggaaaaagtgcgagttagcgtaaacatgcttagatttagtcatccgacaccaagtcatccgttcaactaattagcttgcggcaatttatatcgcaatgcgcggtaaacaagtgcgaccacgtacactgtgataaaccgatctaaataatccgttcccacttgtatcaagaagacggccatcgttttgcccataccggtacctaataataattggactagcatgctcgaaccagacgacgtgatgccatgaaataagatgaccgtaatcgccgtggataaaagtgttccgggaagtgaaataacaccagctagccaccaatttgaccgccacgtgcccggcttgattcgccgatatagcagaccagcaactaacccagtcagcagttgaacgggcatgaagaacagcgagtacaggtctgtcgtcgcacccacgataactccggtggcacccccggccaacattccacccagtggtccaaacacagcagcagccaaaacggtaccaattgaatctaaataaatcggtaattttaacatcaaggcaatgttactgccaacaatattcagggcaatgcagagcgccaataacgtaattgcccgcgtttttattctcttcatgcactcaccaattggtgcaagacttgcgttaaatcaggatcagccgcaccgaccacagtcgttaagaacaaccgccaaaaagctacgacgtcaaccttcgtcatgatttgactattgggtgtgttgtgccagaaatcatgatcatccacgattgactgcccacgcgcgacaccatccgtcacaaccgtcgtgtagctttcaaagccactcagaatcgttgggtcaagcattccggccacggccaacggatcattgatcacacaaccaataacccgttcatattcccaatgaaagtcaaaataaaaggttgtaattttctcaacaaacgcccccattgctggattgacgtctttaatatacgttaataaactgggtgtcaacacgatgttacgcgtgacgtctaaaccaaccatctgaatgggaacaggcatcaagtcaaagacgaccttggccgcatccgggtcacaccagaagttgtattcagccactggcgaacaattaccgtgactccgataacttccacccatcagtgtaaattgatcgacttgttcaaataagcgtggatcacgttgcagtaccgttgcaatgttcgtcaacggtcccaacgctaaaatcgaagtatcaggtgcttcaatcagcgtctcttcaataaaaccagcggcatcttgaatcggtcgtaccgccgttaccgctggaatctgactattccctaaaccatcatcgccgtgggtgtcttgcgcactcgtgtaggcgacttccaatgggcgattagcgcccaaatagactggaatatccaatcggtcagccaaatctaaaattttcagtgcattttccgcaccgatatgggttggcacgttcccacaaacaattgtaatcccaatcacattaagtgccggtgatttaagcgccaataatagtgctaaactatcatcgatcccgggatcacagtcaataataacgttacgcgtcgcattcattctcttacctccgataactgaagttcttggttttttatcctgggaagtttacgaaccaggccagctcgcctaattaggtcaaactgtatgtgatgaaatgctaatccaattatagcggacggtggggcccttgaaaaccaccaatcgttacttcaactcacatcttgattgcccgtatgctacttctccgacaatgatcaccacgacctgctcaacccgctgtggatactcattctcattagccccacaacatcattatttgcagcattcacacgctcccagcgacaccttaagtagtttcccacctcccatttcgaaccaattatttaattatgttactgaacttttaccggagttcagcaagtgaatgaccggaaaacatggtacaatatgactactaaagataaagtaggtgtcgaatcatgcgtaaagttcagttttatggggccatttcaattgacggttgtttagccactaaggataatcggctggactggctgttcaaaacagctggtgccaacgatgcccccaccgaagcatttatgcagcaagttgataccgccatcatgggccgccatacttacgaatacacgatggaacaaaccactgatcaactcattaatccatataatccggcgacccacaatattgtcatgacttcccacccccacaccggcgatgaacgcacccagttcaccaatacccccgtcacgaagattgtcgaagacttgcgccgtaccgctggcaaaaacatttggattgttggcggtgctggcgtcttaatgccgctgttagctgcggatttagttgatgagctctacatccagattgcaccagtcattttgggtgacggcattcccttatttaaagcaattgaccagcaacagcgctttgaattagttgacaccaatcgatatggtcagctcgccgaagtccactatcaacgtttaacaactgaataatgtcgtgattaaaaaatcccagcccgtttgcaatacgcaaacaagttgggattttcaattgctttaagcttcacgttggcgtttaaccgcctgacgaagtaatagtggtgcaatcagcgtcgttaaaatgattgccgtgatgactgccgaataacgatcagctgatagtaatttgccttgataaccaatctgtgcaatgatcagggccatctccccacgtgacaccatgccggcgccaatctcatagccgcttaaccaattaaaacccgccaaccgtgcgccgatcccggcaccaatgagcttagtggcaattgccgcgacggtaatcacaacgatgaaccaaaaatcgttcaggaaaccattgaatgacatattcaacccaatactaacgaaaaagactgggataaatacagcattaccaatgggttgaatatgctcatcgataacttcatgatagtccgtctgaccaacggcgataccggcaaagaacgcgccaatcacagcacttaaaccgattgcgtccgctaagtatgagagtccaaaacaaatcactagtgacatcagcgtgatggaggttggaaccagtagggcattccccacggccattaaatgcggcaccacccacttgaccacaaagtacagcgccacaaagaacgccaactgaatcgccagcgagagtcccaagttggttgaggcatgactaccgccaccactgacttcactgccaaataagctgatcatcaaactcagaatcaaaacagccaggacgtcatcaacgaccgctgcacctaaaatcgtcgtcccttctttaccatcgagggcgcctaactctttgagaaccgcgactgaaatcgaaaccgatgtggccgcgaaggttacgcccaagaacaaactttcagtggcgttaaggtgaaatagttggctacaccagtcaatcaccgcaacgggtagaatgacccccaggaccgcaactaacaaactaggacgccaatacttcttcagcaatttcaaatcgctctctaagccggccatgaacattaaaataatcacgccaagctccgcgaagtctttgataaaacttgttgctgagacccaacctaatacggctggaccaagtataattccacttaacaattggccaatcaccgcgggtaggcccattcggacactcaggtgacccgcaaccgccgtaacaattaaaatcaacgctaaactaccaacgtaatccattaaaaacctcctaaaaaagggcactgcaagctctgactacccaacccaaaagtagtccgaattcttgaagtgtccttcaaccgtaaaatctattgtgcaattagtatagcatatttttatgagtctagccgtgacatctacttatgaaagcggttataataactcatatactgttaactgaaaggtcgcttagtcgtgttgaacattcctgattttcgtcaacgttttggttttttagtcttttccattattctgaattctgctgccaacgcgctcaccatcgccaccagcctaggcagcgccgtctggactggctccagcgttaatctagctgactggacccatatttcattaggaaccaccttattactgtacggtgtggttgtcacgattctcaaccaacttctgttaggtcactttgatcggcggcggtttatctccaacttgctctatatcgtgccctttagttacctggtccaatttatcggctacttttgggattggctacagattcccgccctgtccctgttaccacgcttaattctaaacgtgcttgggctattaggcgttgcggccgccgtctcgatttaccagcgttgtaatttaattcagcatccgaacgatgatttatcatatatcttacgctttcggtttttacatggctccgctattattgctcagtggaccagttatttgccacctctgacgattatcgtcgtttcattcttcgccacaggtcatttgcgcgccattggcttcgggacggtctttgccttaattgctcaaggtgccatcatggggtggtctgatcatcatgtttttccccatctcaaacatcacgtggatattgtccaggcgcatcatccggcctaaatgaatcttgacaaagttcaggccaagcctcaataatgagagtattctaatttattggactgaagtaaatgaatttaacgcaactaactagtcaaatcattttgatgttcattctcatgctcgtcggcctgctcgttaacaagctcggcttcatgcatgcccagacttcaactgatttaaccaatatcctgttatacattgtgtcaccttgcttgattattcaagcctttgaaaagacattttcagccgaccgcttgcaaatgttagcccgggtcattgctggaattgtgatcatttatgtgctcatgatcattgtgacacaattactattcaaacgcgtctctgaccagaatttgcggcgcattatgcgttacggtgccgtatattctaatgccggttttatggggattccattaaccagctccctattcggtgcaactggcgtattctatgctgttgcctcgttagcggccttcaatatttttagctggactcacggtatcaccctcttcaccggacaacagggcaatcggcgggataatcttaaacagatcgtctttaatccgaatatcatcgccattgttgttgggctactgatcttcgtaacctcgctgcaactgccaacgattgccaatagcgctattaaatatgtcagttcggtcaacacacccctgtccatgatcgttattgggaatagtttggcagacgttaaacttaaccgtgcaacactcgataaacgtctttggttagtcatcttattgcgcaatttattgtttccatacttggcgattgttgtcctccagctaatgggtatcactggcatcccattattcaccacagtgttaatggctgcttgcccagtcgccggaatcgtcgtcttgttctcgctcaaagtccacggtgatcccgggccagccgttgccctaatgagcatctcaacgattttaagtgtcgttaccattccaatcgtttttgctttggtcaacttacactaatgtgtctcactgcttttagctaagactaagtaaacgacaactaaaaatgagccatcagaatttttcattctggtgactcatttttaatgactagcatttgagatacggcttaaacttggatccactgcgttttagtaattggcagaaagcgcgctaactttagtttgtgctaagtcgtgcgacgtccattggctttaaactggctggtgtcaaccttcagcactagcctatctcagccataaattgcactgcaaaacagtggctactttgcaaccgctcgtagttgttcaataacctctgggcgtggctgagttagtccggccggcgaaaacagctgctcgaccaaagcatcgctaagcaagcgacgtcgatgtaataattcaggaattgcttggttagtggtgagcgcttctttaatcagcgcggtagtcgtctcgtaaccaaggtatggcgccaaaacagttgccgtaatggccgaatgtgccacttgatctgcacagcgttggcgattgaccgtcaattgccgcacacagtgatcgactaatgtagtcaaggcctgctgtaaatgctgctcactggttagcaatgcccgtaacataatcggctcgaaagcgtttaattccaattggcctgcttccgctgccattgttaccgtcgtgtcgtgaccaatcacttcaaacgcaacttggttaacaacctccggaataaccggattgattttacctggcataatagaagaacctgcttgctgcgcgggcaaattcaattcaccaaagccagcttgtgggccgctcgccagcaatcttaagtcattgctaaacttggaaaggtcaacggctaacgtcttcatggccgcagagaattccacgaacaaatcgcagttttgcgttgcatcgatcaagtctggtgcggctactaaatctaaatcagtattttgatttaatttcactaaaatctgttgttgatacgtgtgagtcgcgttgatgccggtaccgattgcagtcccacccaaatttacgattcggagatgttcgcccgcctgccgtacacgggtcaaatcacgcttgaataattggtaataagcatgaaaggtccgcccgtacgtcgtcggtaccgcatcttcaagctgagttcggccaactttgatggcatcttgataacgctgcgatttaaccagtaacgtttgtaccaaccggctgagtgccgttaatagtcctgggagttgcatgcaaagcgccattttaccggccgttggaaaagtatcattggttgattgtgattgattaacatcatcgttgggatgaacggcaactgccggcatcaatcggtgagccaaattagccaccacttcattgacgttcatgttagccgaggtcccagcacccccctgaatcgctggcacaatgaagttatccgcgtaacgccccagtagtaactgattacatgccgcaataatggcgtgtgccttatcattagacaaagttccggcagccgcattcacactggccgccgctttcttgatttgaacaagactttgcatgatcagtggatgcatcaattccgtcgtaatcggaaaattatgaacggcacgtaacgtatgaattccatacaaagcatcatccggaacagctaacttaccaatacaatcagcttcaattcgcatagcaaaaccctcttatttagatttcatgttacatcttctaacatgaataattagagtttagaccattttctctgaaatacaatccttttaattgatttacgactaatattaagttcaacgccaattatggttaatattcattaagctcatcatcagcatacttcatattaattaactgtcccctactgccagcgcctataccaatcattaagttattacacaaacatcaacagcctacttaacaacaggtatcgtgctagtcattttaggattaatcatgattaaaacgtgtcgttttttaagttcaaaaacggccagctaaaaaccgctggaaacaggtgcgagtgggcgtaaacatgcttttcaagttcgtcctacgccgacttccaggcatttctgccaattgctggaacgcggtggacacagatttaagccgaagcccacgtcttaaatactggtcttccactaaccaagccaaggacgcttgctaagtggaatttcaccgctgagcattggccgaaacgccttccagtcgggacagtattcgaatggtggacatgtgcgtacccaacttttggtaaattcgtcattgtttttcataaacaataattttatcaatcaactgtcagggtgaaaatgatattaggatgtctcactattcctcaatcaacatcgtaataattggccgtctcgacaaagtggttaatacaaccctaacgtttcgtttaaagttcccgtatcaaaatagccaacaacagattgtgctaagttaagtggccgttcattagccattcgagcgggttcccgactgtaggggctgggtgacaatgctcagtagccaaattattcttagtcggaagtgattttcttccggcttagaataagactcgtatttgagatgacgcgggttatgcgttagctcaaatcgacgtcggctgcgttccagcaattgtcacccagccccggaggtcggaataggacgcacaccggctgacgaacaacaatctaaacttgacacgttttaatcatgattcatgaccgattaactaatacactgctaatgttgcgcttgtcgtgtcaccacccgtggataatgaacaaagtgggcataaaagccaatcattaacacgacgaccgctaacccgcagacgccgttccaaccagctaaatcccataagacgttgccacaaaatgaacctagggcgccacccatgaagtagccaaacatgaataccgaattgaaacggctactggcatggacatcgatgctttgaatccgtgtctgattcgcgacctgcccgaattgagtacctaaatcaagaatgacaataccaataattaaccccaccaaatgcgtaccactcagctaaaacactacgtaggctaatgttgataacactagacccaagccgataatcgttcggggccgaaaacgatcagctagacggccaattaaaggggctgctaacacaccggtaacacctagcaacgcaagcagaccagcttcacgacttccccacccgtattgatgttgcaagtaaaagacgagtgttgcccagaaaatattagaaacaccaaacaagacaaatccgttaacagccgacgctcgcaaaaccggatagcgttttactaactgaggtactgtctgaatcatggctttataattcgtggtatgtgtcgtcacgggatcatgcggtaattttcgccacaagacgagccacaatcctgcaatcaagatagcggcaatcagatagaccatctgccaaggcaaatagctcgcaagtaccccactgacagttcgtgacaagagaacccccacgagcaagccactcaggacgttgcccaagacttgaccacgctgattacgaggtgcgagaaagccggcgtacggaataataacttgtggtgccaccgaggttatcccaatcagtaagcttgccaaggcgtacacccaaatattgggagccacgaaggctagtaacgctgaaatgattgcgagtaccagtaagcgcataatcaacattcggcgattcatgatatcacccatgggtacaattaagagcaacccaaaggcatagcctaactgcgtcagcattgccaccgcgccaataacggcgtttgggagattaaactgttgcgcaatgtccgcctcaatcggttgaatataattaatattagccactacaatggctgcggagatcgccattaataggaccgtacttttatttaaagattttgaattcacgttaatttcctttccaattttgagatttaacagcttagtcaaaattagaaagcttgttcaaccctgatgatcaaccagtgttttaactgttgatcaacggggacactaccgcgcacacctagttaacccactgcttagcagcggccaaatcagtaaccatatgggtcggccgttcagaactagtcggttgtcgctgatcacgattaatccaaatcatcggccactgcatagcactggctggaacaacatcggattcatagccacgtgcaatatgccaatgattatctgccgttaacttaaaacgctcttgaaccgtttcaaagaaagctgacgctggtttgtaagcttgaacgtcttcagccgtaacaatcgctgtgaacggcacctttaaagcagcaatgttggccggcataacatcccaggaagaattcgacataataatcaattgatagcccaattgctgccaggctattaaggtcggtataacatcggcgtatggtaataggtgtcgttgcacttccaagcattcaacgtaatgactttcaaagaagtgtctctgttcaaacaatcgatctaaatgcttaagatcagcccggactaatgttgaataatctagataaggattgacactggcaggctcgtcctcataagtcgcgtaggctttgcgaaccgttagtgggtctaaaccaatcgccaatcctaaattagccacccattgatacagcggctcagtattaattaacgtcccgtaacaatcaaatgttaaatattttttggtcatattttttagcttccttactgaatgtcgatgaattgtgctggctatcattagcacgactcatcacaaattaactaatattatctattttattttaccacgacaccgaacactcagcagaccgccccagtaccaattaataggtctaggacttgcatcgtgatatacttattgattgtgcattattacagaatttataaaagaaaggacggtattatgccaactcaaaattcaacgttgccgcttgatgccaacggccagccctatcaccggacttggcttgtattgactttacttgtcgggacgttcaccaccttcattacccaaacactattaacgacagcttttccaacgttaatggccgattttcatatttcagcaaccgctgttcagtggttgaccactggtttcatgttaatcatgggaatcatgattcccgtcagtgcctggttactgacccgaatcaattccaagtatttgtacttaacagccatgcttatttttggtctgggaactacgctggcgtactttgccgtcaactttcagatgttgctgattgcccgaatgattcaagcaatgggcgtcggaatttccgccccagtgtttcaaacaatcatgtcttcagtttatccacccgaaaaacggggttccgcaatggggacagccggaattgttattggcttagcacccgccatcggaccgacactctctggctggattattgataactattcctggcgggcactcttcttattcatcctgccaatcaatatcctagtcatcatcgtttcattcttcactttgcggaaagtcttaccaacttccaaacaaccaattgattggtggtcagtcttgatctcaacaattggttttggcagtatgttatacggtttttcatccgttggtaatgctggttggggcgacccagtcgttctcacaactttagtcattggtctgattttcattggtctattcgtctggcggcaacttcacatggatcagccattattggaattacgtgtctttaagattccagctttcaccctatccgcaatcctgaccgccctcgcttacatggctatgatgggcgtcgaaatgattttgccaatgtatattcaaacggtcctcggtcgttcagcaatggactctggattgattttattacctggcgcaatcatgatggggattatgagccccattactggtcgcatctttgaccatatcggtgcccgcagactagcaatgacggggatgttactcctaacgctaggaactgctttcttcctatcaattagtgccacgaccccaatcttatggatcatcgttgtttacgccattcggatgtttggcctgaccatggttaccatgcccgtcacaacgaccgggatcaatgcgttacctttccggctgatttcccatgggaccgccgccaacaacaccctacgtcaagtcgcagcttcaatggggacggccgttttaatcagtgtctactccagcgtcgctaagtggcaaatgccgggacatcaattactgacacaggcacctttgaaataccgtcaggacggaatcaccgcaaccttaactggttatcacatggcgttcgttgtctcactcattttttgtgcgattggctttgggattaccttcttcttaaaagccaatcattcaaaaaccattagtcaggaggatgatgccgcatgatcattgtcttactaattcttgcaacccttgtctttgctggcacgatgattttttcaccagcaggccgcaaccgtctcattgccattattattagtggcctgattattgccgctagcctcatcgccctcgtcctaaacgacaattaccattggggcatgcacgaggtcacccgcacgcagattcaagacttagccccgctaaaatccaaacaagtagcgttgcgggtccagcaactcggaacagggtctgaacgcgtcatcagttaccgggttgcagccgccactaaagtcagtcacacggtgaccgcaaccaccacaacaactaaactgactagcggttcacccgcgcaggttcaactaaagaccacgacttggcagttcaaaaatcacctgacacacgtgttattcagcctaggaaataccaagacaaaaattgttcaacgccaatatttgtttacaattcctaagacgtggcaagtggtgacagttaaaaattagacgttaataaaactgactaaccatcttggctagtcagttttattttgtttaatcgtcatcacttgtggcgcttcgccagccaatcaaccgctgaaacctgatacacattctcatcatgatcgccatccaataagtgctgaccacctggatgctgaatcaaaaagtcaaagcccgcccgttgcgccaccgcattgcttgcctgattgtccaccgccgcacgaatccgcaaacattgccgatgatactgattaaaacccaaatcacaaacgccacggacggcagccgtcatgacgccgcgtccctgaaatggtcgtcccaaccaatagccgatgttggcactgtggtcgttatcatcgaagtggtcacagctaaccattcccgcaacccgttgttcaacgacaatgactaggttgagcgcttgcgcttgttgtaactgagcttgtgcaaaagttaaaaagcgttgttcatccgccactgtttgaatcttagccacccatggcaaataatactgatactgcgcacgattagcggttaataatgctagtaatgccggcgcatcgctttggggtagcggttctcgcaattcaatcgctggtgtgactcgataagttagcatgaacattcctactctcttagatgaaaaatcgcaatcatgattaattgaatgattaaccatgattgcgatttaagtgtatcaaaacccaattaatgttgcagtaatggtagattgtaaaattaatccgaacgctgttcggacaaaaaagatcagcttcctttaaaatggtgtttaccacaaacccatcttttaggagctgatcttttgtctagtataacctattccgaacgaattaaaatcgaaaccttttgtgaactagggctgtccaatatccaaatgggcgttcggctgaaccgatcaccgtcaacaatttcttatgaattatctcgatgtcaaccttatcaggctgaattagcacaaacagatgccgaatacaagcgatcacgatgtggtcggaaaactaagctgagcgatgagttaaagcaaaaaattctcaaccatttacgtctaagctggtcaccaggaatgattgctcacgaatttaaactagctactaaatctatttataattggctaaatcaggggagaattggtttctccttgaatgatctacctgaacatggcgtacgccaacggcgtaacgttgaccaacgatccaaatataatcaatctttggggcgatcaattgaacagcgtcccatgatgattaatcaacgtaatcgcatcggcgattttgaactagatacatgtcgttggtcctcgtgggcatagtaaggcagttttattaactttaatcgatcgcaaatcacggttcctttgggcataccggttaaaagatcggacgacagcgactgttaatgaagcactaactaagttcctaaccacttttaatggtccggtgcacagctttactgtggaccgtggcactgagtttagtgggctagtatcacttgaatcacaatatggtattaagacctattactgccatgcttatacgccagctgaacgtggcagtaatgaacgctttaatcggaatttacgttatttttatcctaaagggactcgttttgagcacattagtgctcaagatttaacgacgacgttactccaaattaaccagcgaccgcttaaaatactcgactggcaaacaccgtatcaggttatgctgacaaatttgtccaaaaattcggattaaatttgcaatctacctaataacgtaattaaaatcaaggcgctgacgacctgaatcgtccccacgcctaagccatacagtgctaagcgcttgccagctttcataaagttaacaagattcaaacgtaacccgatagctgctaacgcaatgatttcaaaccaactactgattgtatgagccgttgcgccaataattgctggtaacgaaatcaagctattcaatgcacataagattaagaacccggccacgtaccatggtaaccaatgaccgttcccattaccactgacgacagcatcctcagccaattcattttcaatcgtgcgttggtgtaaccggccaaaaatcaaaacaacgacgactagcatcataatccgcataattttgaaaatcgttgcaaattgaaccgttgtttgattaatcatactagctgcggccactacctgcccaactgattgtaaagttcccccaatcaacgcccctttaagaatgacactgccaccaaacacggccattcctaagaccggtaacgttaacatcagcactgtccccatcaagttaactaaggtaatgacagtccccttatcatcttcatccgcgtcaataacgggggcgattgatgcaatcgccgacgacccacacacggcgttaccgccggccatcagcatacgtaccgactggctgaaacccagcttacgccctaaccacaaagccccaacgatcgtaatcgtcatttggcaaagaataaagagcacaccgaacccaccaattttgccgattgtctgtaccgtcatcgtcgcaccgagcaacatcacggaatattccaacagcttactttctgcgaacttagtcccccgaccaagttgcggttgtttcagaaacgtattgccaccaatgattcctaatagaatcgcgatagtagccgcacctaacgctggcaaaaattgcgccaatccttgactaataattgcaatgaccagactggtcactaaccccggtaaaatccctttgaccttcattcgctttctcccatctctatctcgatgcttttaagtatacgaaagttatttacatttgagaaataaattattatgatagttactattaataaacataatagttaggggtgaacacaatgtttaaacaattggaaacgttctgtgcggtatacgaaactcgcaacttctcccatgccgccgagcaactttttatttcccagccgaccgtctcaacacaaatcaaacaacttgaagccgatttacaaaccacgctcttaacacgtaacgggcgccaagaaatcgttcctactgccagtggtcagctcctctatcaacaggctcaaaagctgttaacaacttgggccgctaccaaaacagcggtgcaatcaccacgccacttagtgaaagttccttgccggattggtgcctcacacacaaccgggcgtctgattctacccaccttattagccaatttgagtgccgtcagtgatcgctttgactttcaagtgacgcttgccaattcggccgaaattttgaccgctatgtcccaacacaaactggactttggtttagttgaaaagccactcgttactgaccagctcaatcgcttgccatttggtcacgatgagctcgtccatgcgggcgactttgccagtcccctctggctgctacgtgaacctaattccggtgtgcgtcattataccaacgcctttttaaaagcccgcaacattcagccagcacaagtcatggtcatccacagtaaccaaatcatcgcggacctcctcgctcatggtatcggccaaacaattatttcacgtcacgttttaagcaacgagattcccatcgaacagctaagtgctcattaccaacgccaattctttttactgactaacacgcaaccggcagcggcactgcgccccgtacagactgcaattacccagtacctaacaacgtggtcagattagcgatccccgccgttgttattaggtctttttgacattagcgtttaaaaaatggtctgaccactaaagtcagaccatttttgatattcactgaacaaccggctgccactgttgccaaacttgttcatcactatattgttcactactccgataggcacccttgctaagtcgttgctgacgttgcggactttcaagtgttcgggtcagcgctctgactagttggttgacggcaccatccgtgaccagataaccattcttgccatccttcaaaacatccttaggaccatagttaatatcataagcaattgctggcacaccatggctaagggcttcaattaacgataatggctgcgcatcactttcaccagtataaacgtaagcaccggcttgatcataagccattgttaagttcggttgatacccagcaaaagtcacggcggtctctaggtgcaactgggacacttgctgttttagacggtcaagttcaccaccatacccgtaaatcactaaggtcgcatccgtaatcttatggtgcacttggtcaaaagctgtcaccagctgatcgacgcgccgttccgcatccaaacggccggtataaataatttcatgcgcatgacgttcactgatcgcaattggtgcgtgctgagcttgctgtttggaaacaacggccgctgaaatcgtcaggattgggacactcggttgaccaccgagccactgcgtcaaatcttgcttctgttgtttggtactcgtaatcacaccgtcccaagcactcagaaactcgtgcaggccataaacatacgcgttattcaaattagaatagacttgatcacgcggatcgactgcatgtggcgtgggtaaccacaaatattttttagccgccgtctgcatgttcaccaccggccactgagcagctaacggccgatccgcaataaagacgttgttttcatcatattgcttgttcagttcatctaagaagaaccggtaccattcttgttcaccattaaagtagtagtcacggccatgataattgataagatggcacaacgaaacataattagtcccattattatcatgcgtataatactgttcggccatccgactaccatctggtcgatagaaaatatccgtgattggttccccggctgacgagaagaattcatcacgggccttaaagccccgttcatcataatcagtacgctgaacaagattattgaagtgatcaaaaatttcaatgaagtacacatgccccaccgtgctggggacaaagtggaccttagcaaccagccgatcaccagctcgcacctcactgacattggggtccggcttaatgtcataggcagttggccagttcaaatcagccatcttgatgacccgactggaaaagctggtcgtttcacgaaaaaagtcaaacaagttggccatctgatcatcggcaatattgaagcgccgcatattctgatgtaacaaaccatcgaattgacgcgttactagtttagccggtgcctgatgatctttaaacaactggagccgtttaaattcggcatgttccacaccagaatttaacgccattaaatattggttcacaaaaaaattcatcgctgtgttgccccctcaacttgataaaaatcggctgcggctttcatgagtggttgccactgttgccaaacagccgttgtgctaaagcgttgggcatcttgataagcctgttgactatacatggctaactttttcggctgcgttaacaagtcgatcatcgccgtagccaacgcattttcatcattgaccggcaccaattgaccatcgtgaccgtcccgaataatatcacgtggcccatatttgacatcataggcaatctggggcaccccgtgggcctggccttcaagcaaggcaagtgcaaaaccttctgcccgcgacgttaacatcgccaactgcgcatcattatagacagctgttaaatcggtcgtataatcattaaacgtaactgccgctttcagtcccagctgttccacaagttgatgcagttgtttgccggtatctccatttgcatagccccagaaatcaagggtcgcattcggcacttgggccaatacctttttgaatgcccggatcacctgatcttgttgcttttcttcggctaaacgcgccacaaaaataatcttgcctgcggtgcgctgatcaaaagatggcttgggcgcattcaaagtcgcgtcatcgacaatcccaactggaatcgtataaacggcgggttgattgccaaagcgggcttgaaagtcagcagtttgttgcttagtcgacgcaataacgccattccattggtctaggttattgagcgcgtaagcataattaaagttgagactagccgtcttcggatgtgctggatcattaacgtgattactgtgtaagtgcatgactttaaacgctttagttcgcatgtgaagtgcggcgtaagccaactcatacgtccgatcaatgacaaagaccgcatgcggcgtcctccgattaagttcatcgaggaaaaaggttgtcattgccgtttcaccagcaaatgaccagtcttgcccctcataattaatgaatcgataaagtgaattttggacctgattttgtcgatctgccatatgaaatgtctgatagacgacctccccgtccggattaaagacttgttcacttgctacttgtccatcagcggcatagaactgttcaagccctttaaatccccgggtatcgtaccaatcggtcttcactaacttaccattttgatcataatattggacattgttcagttgtttttgagtgttcagaaatgtattgaccttcattaataattggtcattttgataaacttcataatgacgcccaacgggttgcacccgcaagtccggtgctagatgcaggtcttcaatcgtcatcttagtcgttgaccgttcactggaatgctgaatgaaatcaaacagattaatttgattttcagccgcaatccctgctgctgtcagtgtctggtgtaacgataatgaaaaaaatcgcgtgaccatcttagcaggaacgtgatgctggttaaaaagtgccagccgtttcatctcagcatgttcaattcccgattttttcggattaatgctggtattcacaaaataatacattattactcgctcccttacacgacgttctgcttaacggtctcgattataacaaattttactgaattaataagaatatcgctcacagctttaaaccattttttaagttaccttctgaattttaccgcgagtgtgatgataatgtggcgaaaacatgatgaaagtgttaacttgttacaccatgttactttattacaaaattggctcaaaccgtaatctgttatttattgctttgcaatctgcggtcggtatactaatcaccattcaatcgaaataacaacacaacttttataggagtgactgattaacttatgaaaattaaaaatgccctattaaattcattggcagctaccggtctgttagctttaggtactaccgttgctaatgccgataccgttgtcgttaaagctggcgatactgtcagtgaaattgctttaacgcataagacgaccatcaaagcgattcaaaaagccaaccatttaaagaacgttaacttgatctatatcggtgaaaaactggaagtcaacggcaaacaccacgcaaccacggttactgcccaagtaccaactagtgctgcttcaagtacggctagttcgaccagtactgccagttcaacggccaacagtactagcacccaaagtgccagcagcgcatccgttagcagcagtacaagtacgtcagcagctagcacggctaccagttcgtcaacgacaagtgtcgcctcaagtagtgctgccagctcatcaagcacaagtgctgcttcaagtagcgtgaccagcacgtcaaccgccagcgcggcctcaagcagtgccaccagttcatcaaccagcagtgctgcttcaagcagtgccgccagttcgtcaactagcagtgccacttcaagttctgcaacgagccaagctagcacggcgtcaagttcaaccgccacttccgcatctatgacgaagttgagcaacaccactgcttccagtgccgccagcacaagtacggcagccagcagtagtgctaccacttcaagcagcaccacaacgagcactagcagcagttcatcaacaactagcacatcaagtagtgctgaagctgccgcaaaagcctggattgccaacaaggaatccggtggctcctataccgcatctaacgggaactattatggtaagtatcaactcagcaagtcacttctaaacggtgactactcagcttctaatcaggaaaccgtcgctgaccaatacgtggcttcacgctacggttcatgggtagcggccaaggccttctgggaagccaacggttattactaaacacattcatgcacaactgaacatacaatcagcgcggtcctatatgggggccgcgtttttctgttgccatataggtgcatcggacttgcctgactgcaaactggcaatccccccatgatcggcccttattgcagtccttcatcaaccactatgcaaatggtctgctggtaaagtcgaacacgtgcaagccgcagtcaatttgggagggcttttcaaaagtccaattctaccatgccccccaccgtcaacgtaatcacgttacgcaggtcactacattgacacactcgtcactaagattgcattgcaaattagcggtaatgtaagcgttaatctgttacactatgtcttaatcgggcatgttttattttctaaaaagtccgtcagtaagcaaattgcgcttaacgaaccgcttacatgatggtaaactttaagggaagtctaatctagtttgggagtgaatcaattatatgaaaattaaacacctattattatcctcattagcaacaactggtgccattgcccttggtgcaactgctgctaaggccgatacggtgacggtcaaggctggtgacactgtcagtgaaatcgcagacactcacaaaacaaccgttgccgccgttcaaaagttgaaccatttgaagaacgtcaacttaatctacgtcggggacaaactacaagttaacaaacaccagacagttaaaatgacacgggccaccacttcagtagccacaccaagtacgacaactacaacaactagtgccgccgttcaaagtcctactagcaccgttaccgccacgtcaacggttagtcaaagcacagcgagtcaagccagtgccagctcagttaccagtgcagccagtcaaagcagcacatcagccgttagccagagcagcacgagtcaaaacagcgccagctcagttaccagtgcaacgagccaaagcgtgacgtcggccgttagccaaagcagtactagtcaagctagtgctagttcagtcactagtacgacgagccagagtgcaacgtcggccactagccaaagcagtactagtcaagccagtgctagttcagtcactagtacgacgagccagagtgcaacgtcggccgctagccaaagcagtactagtcaagccagtgctagttcagtaaaaagtgcggctagtcaaagtacaacggtaaccagtcaaagcacgacgaccaccgctagttcagccgcaactagtagtgcaagtactagcagcacagctgccagtcaagctagctcaagcacggccagttcaacaacaagcacgacaaccagctcgactagtacatctgaggctgctgccaaggcctggattgctgctcgcgaatctggtggctcctacaccgtaaccaacggtatttactatggtaaatatcaacttggtcaatccctcttaaatggcgattattctgccgccaaccaagaagcgactgccgacgcatacgtcgctggccgttacggctcatggactgctgctaaagcgttctggcaagcaaacggctggtactaatcagcatctgcaattatcaaattcaagctttatcattgacatcaaagccagcgcggacgactcatcgttcgcactggcttttttcattaagatatagcagtgatgttctgatttaatcaggtcgtcacaccaccaattctgttatactaacgctatcctaattgagacggagggctcacacatgcacttaacattgacccaaacaaccattaaccagcaaacttactggctgggcacaacgcccaccggcttagcctttgtcggccgtgccaacggtccacgcgacgaatggcaagccttcttcaaatccgctaatattcattatgatcaacaagctaatcaacaggcctgtcaagaattacatgattacctaactggtcaacgccagcattttgacatacccctcgaccaaacgacgggcacccctttacaacaccaagtttggcaagctttaacccgtattccatacggtcaaactgcaacttattcacaactcgccacaatgatcaatcaccctaccgcagtccgagctgtcgccagcgccgttggtcaaaatccactccttattgtgatcccctgccatcgtatccgccgcaaagacggtcaacttggcggctatcgtggtggtttgccaatgaaacgcgccctattagctcttgaaaacgcccgcttgcccaaataagcttcacttagaaccaagcgcacgcccttgtcacaccgaatcaactatgtcatcataaaatcaaacaatgattgctaattgtgccaatagttattaggcctaattaggattaaaacgtgccaagttgtgtaagttcaaaagcagccagcttaggcccgctggaaaaagttcgagttagcgtaaaattacttagttggcgcgtcctatgccgacttccaggcatttcggccaattgctggaacgcggtggacacagatttaagccgcagaccacgtcttaaatactggtcttccactaaccaagccaaagacgcttgctaagtggaatttcaccgctgagcattggccgaaacgccttccagtcgggacagtgttcgaatggcggatatggatgtacccaaccattgatggacttgtcattgctttttataaacgataactttgtcaatcaactgtcagactgaaagtgatattgagataattcactaattctgaatcaaaatagtaagatttaatctctcgacaaagtgctagtgcacttaacgctttgtttaaagttccagtatcaaaatagtcaacgatagattgtgctaatttcggtggtcgttcatcagccattcgagcggcttcccgaaacgtgttcggtgccactaaagcctgtgcttgctacgccaacggactaatgccaaaaccgcattaatccgttggctaggcaatgctcggcttcaactcgtggccccgcacaggcttgagactggaggggctgggtgacaatgctcagtagccaaattattcttagctggaagtgggttgcttccggcttagaataagactcgtatttgagatgacgcgggttatgcgttagctcaaatcgacgtcggcttacgttccagcaattgtcacccagccccggaggtcggcatagaacgcacaccggctgacgaataacaatctaaacttggcacgttttgatcctatttcatgactaattagctcgcacaacacgtaatgactttatttcaagaatttgggggacaaactaatgctatccatcgcacatattcagaagcgtttcgggactgttcaagcattaaatgacgtatcatttgatgtccatgacggagaaatcatgggattgattggtcaaaatggcgcggggaaatcaaccacgtttcacagcatcttaaattttctatcattcgacggtcaaattacttggaatgggcaaccgttgaccgctgatgactacgatcaaatcggctatttacccgaagaacgtagcctaatgtccaaattaaccatcacacaacaaatcgtgtacttggcccgtttgaaaaatcagccggcacgggtgaccaagggcaaaattgccgcatggataaagcgctttgcggtcaaggggcagccgaccgataagattgataagttatctaaagggaaccaacaaaaggtccagctgatttgtactttaattcatgatcccaaactgattatcttagacgaaccgttcagtggtttggacccggtcaacgccgacctactcaagcaagctattttagatgctaagcaacggggcgccgcgattattttttccagtcatgatatgagtaatgtcgaagcgatctgtgactcactcgttatgctacgtaatggtgaagcagtccttaagggtaccgttgaagatgttcgcgcccagtttggccggacccgtctcttcttgacgactgactggtcacaagcgcaactggccgatctaccaggagtcaccaccgttactcaacaaggtgcccgtcgattccgactcgaacttgcagatgcttcagttggcccagcgatttttgatcaagtcactgctggtcattacattgaagagttcagtcagcagccaccaacgctggatgagattttccgaactgaagcgggaggtgttaaccatgaataagacttggattgtgacttttgaaacctacttgcggcagatcaagtcctggagctttttgtcactcgtctttatgcccttcttgttcttcgggttcgtggccgccttttcttattttgctgcacccagcgctagtaagaatgacatcgcggtcgttagcactagcccacaattacgcacaagtttcattaagcagagtcatgtggctaccgctaataaataccaaacactcgccagcgctaaggcggcgacaaagcgcaatgacatcgccggctacctcgttttaacaaccaagaatcaacagttgcaagcgcagttcactggtcctaatgctgtcagcagcggtgacaaggctaagattcagcagttcttagccactgcccaaagccaacgtaacgtacagcgcgcacaactaagtgccaagcagacccaggcgttggctgtacagccaaaatttactgaacaattacagaaacacgctgcttcagataaaacggctaaaacggtctccttctatattgtcgtcttctttgtctacttgattttgaccacttattcagcaatcacagcccaagaaattgccgcagacaaaggcaccaagattatggaagtcatcttctcgagtacgacaccgcggaaatacttcaatggtaaaatttacggtgtcttactagtcattgtgactcagctgctcgtctacttagtgggtggctttgccgtcatgcaattcgttaaacgtagctcactcacaattgatttttggcaacagaataccgatctgatcaatcaagtaattcacaacttggtctcaatcaacttgttgtttgcattactggccgtactactctacaccgtagcgtcggccttctgtggtgctttggtgacccgggtcgcggatgctagcaaggcagcacaaccggtcatctatctgagtatgctagcgtttttcatggccctagcctttcagaacacacccaccaatctcttcgttaagattttctcatatattccgttcttctcatcatacttcatgccattacgcctcattaacggcatggcaacgatgcccgctgcaatcgtgtcactcctgattctcattgcaacaatcattggaagtatgatctacattggccgaatctatggtgggctaatgttacaaacggatgaactcggtttctggggcaacttaaagcgcggcttacggttgaagtaggcccactagttgaatatttataacaacagcaagcacccggtctagcaacgccattatgcgctagaccgggtgcttgtattttttgaattcacattttcgacttatcggcaactagctcaaacaaccgttaacaacagctaaatcaagttaagcctgcttcgtcggataaatcgtaaattcgttaacgttaacatcttctggttggtcaatggcaaagttgaccacgttcgcaacggctgctggactgattcccacttgttgataaaaatcagtcatattctgtttggccgtcttatccgtaatcgtgtgcagtaattccgtattgatggccgctggatataagctgaccgttcgaatattggtaccttcttgggcactttccatccgaatgacttccatcaaattacgaaccgcaaacttcgtagcaccgtacacgccggagccagcaaaggacttaatcccagccactgaagatgtcgtaataatctgaccagatttttgagcggtaaagattggcataaccgctgccaccccgttcaagacgcctttgatgttaatatcaaccatctggtcccattcatccgtgtgcaaggcactgattggcgatgtcggcataatcccagcattattgaaaatcacgtcaagcccaccgaattgcgtttgcgctagcttaaccagtgcttgtacatcggccgacttcgttacatccgtcacctgataggccgcttgtccaccagctgccttgatttcatcaactaaagcagccaggcgttcttcacgccgtgcgcccaatacgactttagcaccattactggctaattgcttagcggtcgtcgccccaattccggacgaggcccccgtaatcacaacgactttgtttttaactgtcatctaactgttcctcctactcaccgtaaacttctttgatcagtgccattgctgaccacgccttaggccatcccgcatagaaagccaagtgggtaacaatttcaacggcttcatcctttgagataccatgatctttgcccatcttaaaatgcgcctttaattgtggaaaatcaccactggtcattaagcacgcaatggtaatcatgctccgatcatgtaaacttagtgcgctttcgcgtgcccagacttcaccaaataacacatcatcatttaatgcggcaaactgtggtgctaatttgcctaagttgtcgcgtcctgcggtttgtttaactgtcatattagtttcctccttcgataactactttaacttttataattttgcataggcttcatcatcaactggttcgagccattcgctagttcccttagtaattgcgatgtgggcaaaccaactatcctttgttgcaccatgccaatgcttcacaccaggatgaattgtgaccacgtcgccgggatgcaataactgggctggtttaccagcctcttgataccaaccttcaccactcgttaccaataagatttggtatccgttatgatggatatgccaattattccgacagccaggttcaaacgtcacgttggaaacattcacgtcgacctgctcatcaccggctaaggcattcaggtaactttgaccgataaagtattgttggtaggcctcattctttacacctaatccaaataggccgctattattagttgttgtcatattaaaaacactccttaattatttgcttgctaactgattgatgaatacagcttacaacttaaagtgcactttaagtcaacaataaagtttaaacttgctaaaataggatttcgtggtattgttattgctaaagttacttcaaataaaagttagaataaggagaattttaaaattggtaaggactactacagaacgttattcaatcggtgacttcgctaaagccgttggtctcagcgcccccacactacgctactacgaaaaagcgggcttgattgaaccacatcgcttagacaatggccggcgctattatgagactgccgatattaactgggtcaaattcttattgcatcttaaaggaacgggtatgagtattagcgaattgcaacaatacgttacctggcgcgcagccggcgacgacacgattccccagcgattagcactactcaaacacgttaaagaagactttctcgtccagttcaacgaagttcagcatcatctacagattctcaacgacaaaattaattggtatgaagaaaaggaagctggtattacccaggatcacgaagatttttcgagttacttgcaacggtttgggcatcacgaataacctgaataacgcacaaccgtcaccacaatcattattaagttagatacaacgaggttcagtcgccttgctcaaaaaaagtaatagtcatttcaagaatcaattcttgaaacgactattactttttttgaaaccttttccggcacaatttaattcacacttattgacgtttccgttaagccagcaattccgtaatcattttttgataaatctcgatgaagcgcccatacatatccaaatcaacatattcattaacttggtgcgctgtaatattgccgggtccgaagacaatcacttgcatatcaggagtctttacaatataagacgatgcgtccgtcccaccaggagcaccaaagtacgggagccgttgctgtaaaacttgttccccaaccttcttcgccaactggaccaactggctatcttccggcgtatgcactgggtagaacgaacttgcgatgtccatcgttagattggcaccatctgcattgcattcagcaacgatggcttccaaatccttaatcaagcgatcattccgtaattctggaatcgtccgaatttttactgacatttcggcactggctgggacggtgttgacctgttcgccaccactaattaacgtcacgacaggtacggttgggcccaatacgggattaacgatagtcttgaaactgtcaaaataggcggtttgtttctgatagtaagtcatcaacatatcgatggcgttttgaccaatcgctggcatcgaactgtgggccgccaccccttgcgctttaatcgtataagtcagtgaacccttatgcgctaattcgatgaagtgttgttcggtcgtcggattcgcatccgccatccgttgcgccgtatcgtcgtcaacacctaacatggcttgaatcgacttggtcagtaaaagctgtttgtccgcaccgcttggttccgcacagatcaacgtttgaatatcatcggcgtaaccgagttccgtcaattgttcagcacctaaatggtcgacttcttctcccacagttgcgagtaaccgcaccgtgccatggagtgggacgtcttgatcgtgcaatgcaatcatcgcgaaaacttcagccattagtccagccttcatgtccgtcacaccgcgaccatacaatcgattatctttgatagttgctgccaacgggtccgtgtgccatttatctgcatcacccaacgccaccgtatcttcatgaccatccaacgcgacgactggaccgtgaccatcaccaatttcggccaccaagttcacccgcccgggagcgtactcgattgattgtgcttcaataccatgttgctttaaaagtgtgaccaaataatccgccaccaattgctcatggttatttaccgtattcatttttacaatatcgcttaatgcctgtacagcagcttctaactgtgccgtttctgccatgccattcatcccctagtcatccttaattaaactgttccaatcaatttaattataccacttcggctaccgttggccgttgtcagacacgtttaatcgacagatttcagtgcatccagcatattgactcgctttaacttacgatgcatcattcccatgactaataaactaaaggccagggtcaataatgccgcgtaaacgtaactcaacggatgaatcgttggtgaaaacattaacgcgttcgtttcagccgtttgcaagatatatgcgtgcaaccagttgcccaagaaacaaccggcaataatgcctaaaaccgtcaatatcagattttcacggaaaatatacatcgtcacttcaccatcgtaaaagcccaacactttgattgtcgacaattcccggatccgttcagaaacattaatattcgttaagttatagagcactactagcgctagtgcccccgccgagatgacaaagatcaatacgactaagttcatgctatccagcattttaaaattagtggctttctctgtactcatcagtgtcacgttctgaacccccgcctgtttcaatagccgatccgcataagcattttcttgctttttcgttgcctgcttaaaccggacatagttcgtgttatatactggtgcctgcttgaagacacgtcgataataagtcggactcatatagataaagtgattgacgtaattttcagccaccgcactgatgtgaatccgcttggtggtttgcccggccaacttgattgttaaatcatcgcccgcctgaacgccatataacttagctaatttttcatcgatgaccgcaccgcgattaccgatatgaatggcctgatgactttgtcggtgccgtaataccacgaacttgcttagcgattggtggggtgctgggataccgagcgtagccgtctgttctgctaccccggactgtttgaccgtcacctgcttggcctgtaatttcaaactagcctggtaaagttgaccacgactaagtgcttgccgttgttggtccgtttcgttcccactacgcgtcaccactgcatcgtagtgccacaattcgttaaattgcttgacgctaatatcaccaatggaatcctttaagccaaaccccgtaatcatcatggccatgcagcccgcaataccgagcacggtcatcagcaaccgttgcttgtaccgaaatagattacgaagtgtgattttatgattaaaactcagccgatgccatagccattgccagcgttctaatagcaaagtcttaccggccttaggtgctcgtggctgtaagagttgcgcgggtaaactgtttaaatccacgcggagcacgaccagtgccgtccccaacgtgcacaacaacgcaatggctaaggcgataccaatgtccatccaaatgtattgaacgttgattgcgggcaaattatacatactaccataggcctgcgcgataaaccgcgggaaaaaattgacgccgaacaggacacctagcgcagtcccaatcagcgcggctaaaccaccataaatcataaactcgctaccgaccgcggtattcgtatacccgagggcctttaacgtccccatctgtagccgcaattcttcaaccatccgcgtcatcgtcgttagacaaattaacgcggcaatcgcaataaagaacagcggaaagacagtcgacagtgccacaactcgttgcgtattttcgtgatattctgtgtaacccggattatccgtacggtcagagtacaaataagtcggcattgtgatggccgcgacctgggcctgcgcgcgttttaattggctttgtaacttgactagttgtgccgttcccgctggtacttgactagcaagttgctgggtcgcctgctgcaatggtttcagcttagcctgggcctgagcttgtaatgcctgttgccgcttacgcgcttgtggttttaaccagcgtttgagttgcgcggtgttctcgcgattcaagcgccgatacttcgccgtgtagggggtgacgccccgcaaatttttgaattgcacgtcaatgcgcgttatcacactggacttaatcacctgcggacgggcatagaccaagtagtccaaagtccctttaccaacgttggtgacgccacgattcgtattttcaacatatgttggtgaattgacaaaccccacgaccttgaatgttcgccgcgtgaactgtgcattgcgcttagccgtactgctaattcgatacgttgaaccgacttttagcttcggctgcaatcgctgtgcttgcgcgtctaacacgatctcattggcatgccgcggtaatcgtcccttaacgatccgtaaccgattcagtcgttgggttgtcggtaacaccatcacccgcacgacttgactattgttcaactgattaacatcagcgtagcgtgtcgcttggtaagtgagctgtgagcggtgttgattcagtactcgtgtatcggccttagtcagccccattgtcgactggacactattggtcgccagcttttgcttcgcataataatcattagctgcctgtgacatatccggaccagtcgcccgaattcccgtataaaaagcaacccctaagaaaatgatcagtaatattgaagcaaaacgggctttcgacgaccaaatctcacgcataattgttttaaaataagctgctgtcattgctgcacctaccattcaatctcatccaaaggcgttggatgagcattatgctcaaccgactgcacttgagcatcattgatacgaatgacttggtcacccagctgcgcaatcgcactattatgcgtcacaatgatgaccgttgtctgcgtctgcttagctgcatcttgaatcacctgtaagacttgcttccccgtctgatagtcgagcgcgccagtgggttcatcacagagtaataatttgggattcttcgcaactgcccgcgcaattgcgacccgctgttgttcaccaccggacaactgggctggaaagttatctgcccggtgcgtcagtcctaccaaggccaacgtctcatcaacgtcgcgtgcgtccttggtaatttgcgacgccaactcgacgttttcacgcgccgtcaagttcggaaccaggttgtagaattgaaaaacgaacccgaccgcttgccggcgataggtcgttgattgccgtgagttgaattgcgcaatgtccacaccatccaccagtacacggccgctcgtaggactgtccatgccacctaaaatattgagtaacgtggactttcccgcaccactcgggcctaaaatcacaacgaccgctccctggtcaacttcaaatgaaatatcccgattagcaacggtgacctgctcaccatttttaaactggcgcgttgcctgctgcacttcgatgtatgccataatttagcctcctatatgtaatcggttactattatcataccgtattttcaagattcacggttagcatttaagccaccgcttgcattttgcctcgcattgcccgtacaatgacaacagtcactgacactgataattccagtgttatcacccgttatccgaggaggtccaactatgattgcccaagccattgcgactgttttaatgctaattgtttttatgttcggttttacttactttctgaatagcctatttttcagacgcatcgaaaaacacgaccgtgaacaaactaaaaaacgcgaacatcaagaccaccactcgtcttaatgctcgcgtcagtacgtattatgttaaaaataggactgccagttaagatcaagggcagccaacttcggcctgtcggaaaagaggttgtttagcgtaacctggctttgattacacgtctagcaagacttacaggcagttctaccaatggctaaaatatgctcgctgtcgccccacgctactagatcaacgcttcattttcctcattcaacttgtcacagtcaatgatcaattgacaaacttctttgtctggcgtcaacttcatcgaatacttccgcccatattcaatcatcgtgtgatgggcttgatgtaattctgccggtgccaacacactcacgattttttgttcaacttgtaacggcgtcgcggtctgagcgacaaagtgcaagcgtttcgagattgccgagacgtgtgtatcgacagcaaacgtcggttgttcaaaaacgtcactcaataccacgttggcagttttgcggcccgcacctggtaacgccatgatgcctttacgatcggtaggcacgacatcggctaattcttcatggacaatgcgcgccgttttaatgatgttgcgggccttattatgaaataatccgacgctcttgataattgcttccacatccgcaacatcggcagccatcaagtcctttggttctggatacttctcaaacagcaccggcgtcaccttgttaaccgagacgtcggtcgcctgagcgctcagaattactgaaatcaaatactgaaacggcgtccgcgagtccagggaaggtcccactggtccgatgtctgcttccatttggtgaattgcccacacgatctgatcatcttttagcattgcgcttaccgcctctttcttatcctgtttctaagttaattttaaggctgagggggtgtaatgtctattattaaaaatatcgcggccttatttctaatccaaactctaatgacatgaacacagtaccattaatttctatcaatcatcatcacgatcagcaaaataggcggcccgttgccgagcccaatattcatggtcggcggtggtgatttctcgtaagacatggcaaggattgccgaccgcaaccacgttatccgggatatcatgagtaaccacggaaccagacccaatcacgacgttactcccaatcgtgacacccggattaacgaccacgttgcccccaaaccaaacatcgtgtccaatcgtaattggccaaccatattcgagttgttcagcacgaatggcggcgtcaatggggtgacccgccgtatataagccgacccgcggccccataaagacgttgtccccaatcgtaatccgacccacatcaataaaaatcgcatcgtaattggcataaaagtgcttaccaattgtcgtgttgcttccatagtcggtatgaaatggcggttcgatatagcccccgtcaccaattttgttgaacattgccgttaacaatcgttgccgttcttctggttgggcttcggttgtttgattaaattcccgtactaaccgtttggcacgatgattttcacgtcctaattctggatcatcagcaacgtacaactcacccgccagcattcgttctttctgtgttttcatactcccagttcctcccatcaatcgcatttcactttcaccagcatagcacgcaattatcaccatgaacacgcattctcgaaagcaaccgcccccattttgagtatcgttgaacttttaagcttttttatactgcgaaaaaatcattatcgtttataatgagaggtatacacacaattaagggagttttaaccattgaaaacatttaaaagcattatgagctgggtggttccgattgcgattggcttgatcatcgccctactgattcgtcagttctggtttactatggtcaaagtcgatgggacttcgatgcaaccgaatttacaaaataacgaacgcgtcgtagcttttaagactagcaaaatcaaagcaggttccgtcgtcgtcttcaacgcctacggactcgatccgaaccagaccgacaaaaacgccgtttatgttaagcgggtcattgggatgcctggggatacggtccgctacacaagttccggtaaactttacgtgaacaacaaattagtcaagcaaacctatctcaaaaataagtatcaacagacgactgggtccttcatggctaatagtcacagtaagttcactggttggacactcaatagtttgagccatgatcaaggctgggccaagtccgtgaccaacaatacggtgccgaagggttactactttgtccttggtgatcaccggagcgtctctaacgatggccgttactgggggctcgttcctaagagcaagatgattggggtcgtcaaagcatggccatggcagaaccgcaaacaatatattaataactaccaaccttaagatttgaacaccttatcagcaagtcgttaactgtgacttgcttttttgttatactgaaaatattatttaaataataaggagcttaatcaatgaccgccaaagtaaaagttgtccttagttggctactccccatcataattggtctgatcatcgcacttttgattcgccaattctggttcacagtagtaaaagtggatggtgattccatgcaaccaaacttgcaaaacaatcaacacgtggtcgccgtcaaaactagtaccattaaacgtggtagtgtcatcgtcttctacgcatacggcgtcgatgccgcccaagctgaccacaacgccgtttacgtcaagcgagtcgtagcagttggtggcgacaaggtccgttatacacatgctggtaaactatacgtcaacaataagctagtcaagcaaacttatcagcctaatcattatcaactcacaactgggtcttatatggccaacgcccacagccaatttaccggctggacattaaccagtttaagccataatcagccagcttggcaggtcaccgttaccaacaaccgagtccctaaaggcagttactttgtccttggtgatcaccgtagcgtctctaatgatagccgtaattggggatttgtcccccaaaacaaagtcattggcgttgttaaggcttggccgtggcagaaccggcaacaatacatcaatcattttcaaaactaacaaataaacgaatcaacaaagttatgaacaacttgttaattcgtttatttgttaaccagacttttatccacagttaataacttaataccgttatccacagtatctgcataagtcttcaattgatttgatcagttttctgaacagattatcagttccgactatttttggcgctgacgccaatcctggaccccaaaatacccacaaataattgggcttaaaggaaccaaaatcactgccatcaaaatattcttaaagaagttgataaagccatccatgaagtcactcttagcctcgacttgcggcgttaatgcggttggaacaggtttgggctttgtccgcttggctgctactgaccatggtcggccagagtcctgaatgatttgctcatcgtctggtcgcgttgacggtgtttccttgggttgtttacgccagacttgaaacacccgcggccaacgatacttcacaattggaaacagcacgagcgcacaaataatactgtaaatgacgaacggattaaattctaacacgatccgattgacttcctgacgggccgtaaaaaacatgataatgaagacggcgattgcaccgtaaaaccaactaattagtaaatgactcgttttccacacgttgtgccacctccccggttgttgacatactcaatcgcaccatacttttacactgcaagccagcttcatagattgggtctggatagttatccacaaaaaagttgacccacacctcaatcatctcaaaaccagcgtgttgataaatcgctagttgccgcaacgatgaattaccagtgccaatttgcagttcatcacaggttggcgctgcttggcagactgcaatcgccgttgctagtagggccttagcaatgccgcgatgttgataggcgggcgccaccgcaatatttttaacttcccacacccctgttttgagcgttgtcaacacgacaacacccaccacttgtccatcttgttgataaccataacattggcctgtcgataagtacgctgtgacctgtgcccaagatggatcggctaataacagtaaatcccgtggaatttgagctgccgctaggggttggattttcatgactgccgcctttgatgccgctgatagccgttaccccaacaaacataaggaatgatgaccgcaataattgctaaagcatactcgcgcaccgttaagttcatggcattgaccacgacaaggtacgccaaaaaaaccgtccataaaaccggaacgataccgccgacccaaaagtagcgactagccgtaaacaggtactcttctaagataaagataacaattgcaataacacctaaaattagtaattgcatggggccacttcctaacttgtgattaacgcagtgcctactgcttgtttaactgttgtagcatatccacaaaacgtccgattgttaagttagccacatcttcatcggaatagaagatgatcatttgggaccgttgttctggggataagttcgcttgggagccaaaataaactaggtaaacgtccgcgctatggtccgtcaaactctgaccataatctgtatctaacgtgaagttgaaatctgcgcccaattgtttttccatggcggccatgaaagcttgcacatccgcagttgcgaccgtctcttggccggccaccgtactcgtaataacattaacttgcattttaaaagctcctcgttaaaatttttaaactcaattttcacattagcgcacttttgtataaaccgcaagccactagttgtccacagtggataacttattccgtgaccggtacagtcaacttatccccagtgtaaaccatcgttgtcaccacactcggtgccaatgcctgtctcgttgccgcacgaccagttgcgacgtaatgcatcattcgcaacgttgcgccgtccacaatcaacaagacctgaccatgatcaggcattgccgccataacctgttgtaaccccttctgatagcgatcccagaactcccgaccactttccgccaatccatccgcatcatgatcgtgcaacaatgtctgtagctcactgggtgtctgatccgcggcaaaagcggccacgctctgataacctagcttagtcgcaaatcctgaccaaaccgccgcgcgttcagtgccttcaaagccgccatagaatggcgcacgtaacgcgactaccgttcgcaacttaacgggttgtgctcgtgagtctaagataatgcgcgcagtctgaatcgcccgactcgtatcactagcgaaggcgatatcaaacgttgtcgacgccaactgctgcgcaaccttggccgtcgcctgttcgccagtcgccgtcaacggcgtgccgctccaaccctggaaccggtcaagttgattaaagtacgttgctccagcaacgactaagtgtaaggtgattgatttcatggttaattctccgttagtttttttagattattcaactattttagcataaaaacttggccggacaaacggactctaggacttgtttaatatgaatttgagtagaattgtaaccaagaatgaaacaactatcattttaaaacatacagctggcaaacaaaaaatcaggataagaatcagatgtgcatccttatcccgactttaattattgtgcgccaacagctcgttcattttggctaaccgagaattagcgaaaaatcgccatgccgaatactcatcaagtcaccacacgtcctttgatggtaagcttaacatcatcattgtgtatttctcttcattagtagcgttagatgtataatatcgaacattgttcttaatcgccataattgttatatgccacagtcatcagaaattaaaggtattatggttcgcttaatatattctattcaggaattgtcacaaagcacaggcgtgttgcctttagttgacagtctagccaagccaacaaatactattttcctaatgtgaccgttttactgaccactaataactagtcgctttagtaggtactggctttctgcgcactaatgacccaatcaccattcttcttctcataaaacatctgcatctgcaaccgccaagtatgcgtacccccaccccaaattcttgcctgaacttggttctgaccaattaaacttgcccggttaccttcaatttgaatagctttgatggtatcttcttttgaagcaaaatattgcatttcttcattttgaatttggtcaatccactccaatttagactgcacataccccgtcatgtgggttaacttcatagttggtgccaaaatttcatttaaccgactgaggtttttctgaaccatagcaatattttcatcacgatacaattgaataattatttctttatccgtcattcttaccacgctttctttacttacatcaagcatgataccaacttttctatgccaaaaccattcagaaatcaagggtcattcataagtaaaaattatgcaaaggtttgtttcaataattcagcaaaagtttcgatataataacctgaattattagcttgccaataagcgtaataattctgaatcaattttcggtcccctttcaccaaagaaatcattttaacaatatctttatctaattgtgttctcatccgctgattgatgatcaaatacccctgattagacgcgatcaacatttgtgcctcgtcatagcttttagcaatcacaaactcacttttgacacctaaaacattgcgataatactcctcttctgagacttgctgatgaccatcaatgatcaaaatacaaggaatatccactaagtcagcaacgtcgattttttgtgcctcaactggcaacgaattgttaacggcaaccataaactcactagcagtcaaaaattcattttgatattcattggataaggcccgccgttgatcagaaaaattcaaatcaatttttcctgtctgtaataattcatagagttcttcgtgcgtgccactactaattttgattttcactttaggaaactcctgagtaaacttcgaaacagtttgtaaaaactcagcagtcccaaaacttcttaaatagccaacccgcaactcgacctcatcattcttttcaattttgatggttttctttataagttggtccacatccgccaaaatatcctgactatgaatataaaagtactgacccgcttcagtaacttcaaagctgcgtcctttccgattcaataacttcacaccaagttgactttccaactccttcatttgctgagaaatcgctgactgcgaaatgtggcagtccacggccgcttgagtaaaactatgattattaacgattgcgataaaatactgcatctgttgaaacattaccggcacctcaacctttacaaaattatctttgaatgttcaaatttgtcatattattttaattagtataaccttaatcaacaatttgagaaatgttttgcagcagaacctgaaccgattccctgccatgcttataaacgaaaaaagtcactagctatctagctaatgaccttttgaatattattttgcatttagtccaacactatcatgtgcataataatcattatcgacaatcgcattcttgacaaaatccgcaattgaattgattgagacatcatgcccaccaaatggttcgccttttttcgtgatttcataatcaacaggaccaccagtaaaccagcccggacgaatcagggtgtagttcaaatcagaagcttcaacaacatcggcggcttcccgataagtgcgtagcactggattactacttaaatttccactagcaccaaccgaagcgggaatttcatcataaatacccattgaagtaataaacagcaatcgtgaaaccttattccggtccattgccgcaacaattttttgggcaaagcgacctaaagaaccactcaaggcaacaaaaacaacgtcttgtcctgcaatcgccttgtctaagtcactatctttagtaacatcgccagcgataacactttcacgctcactagtctttaatcgattggcacttctagcaaacaacgttaactgattatcggtttcattcaaaagcgtttgtcgaactgcaccgccaatagtccccgttgcaccaacaattaaaactttcttcatgtttccctcctatttatcactgacaatgaccaatgacttaatcgcattccgttggtccattgcttcgtacgcagcttgaatatcatctaacataaaccgtttcgtaaagacttggccgggctgaattttccccgtcaaaacagcatctaacaaaacttgcttgtcatccgtcgttacagcagcaatcccaccacgtaagccaatgttcttccaaaaaagattattggtattcatttcagccttttgtgggaccccaacgcgaccaacaaccgcaccaggacggccaactttgactgctgtgtcaacggattgttcagtacctacacattcaagtaccgcgtcagccccagtttcggtcaaagccatcactttggcaactgcttcatcaccacgttcagcgataatgtccgtggcgccaaatgcttttgctaacttttgccgatcttcatggcgactcattgcgatgatccgcttagcgccaagcaattttgcggaaagcaccccgctcaaaccaacggcaccatcacccatcacaacaacggtatcatcttttttgacttctgcgctagttgcggcgtggaaacccgttgccatcacgtcagctaaggctaaaaagttgttcagcatgtcgtcagaataatcttcgggttgtccaggaatcttaactaacgcccagtttgcattggtaaagcgtaagtattcaccttgatagccaccgttaccgccggcttcttggtttaagcaatccccatcaaaaccggctaaacaagcggcacagtgcccacaaccatgggtgaacggtgcaatcacgaaatcgcctgcttgtacatctttaacggctgaaccaacagattcaacaattccaattgcttcatgaccaacggttgaacctgcttggcgttgtgaaatcccacggaaccaccacaaatccgacccacatacacaggcccggagcacccgaataattgcatcggttggcttttgaatagttggtttgtcgtattctttaacttcgacttttcctggttcaataaaagttgctgctttcataataaactctccttaaaattctatttctggacgccattgttacgaacttctgaaacattaccataccaatattgtgcggtaattccgccatcaaccaagaaatcactccctgtgataaaggcaccacggcgatccattaagagttccgccaaattggcaatttcatcgggtgttcctggacgcttcgtaaccattgactcgaacatctttttgtaacccgcaccacgcggcccgttcaattcgtcaacggctaatggtgtcatgataataccggggctgatcgtgttgatccgtgcactgcgagcttgccacttaaccgattcggcagcgacccgtaaaacattggttcgtttcgcatattgataagccgccaatgaatccttgatcacgtccggttgtaaaattggtaaatccaataattcttcagtcggtgtcatggccaaggcttgattatctgcttgtgataaggcgggtaatcggtgtcctgattgcgacgaaatgacgattcccgcactaccgggagccatgacttgaccaaattcttctaacaaaacggcagtcccgtaaaggtccactttgagcacttgctctgggctcgcttgggatggtgaaacgccagccgcgttgaccaatcccataatcttaccaagcgattgtgccttagcaaccactgtcttaatagattcccgtgatgaaagatccgcttggatggtcttaacgttaaatccagcttccgtcaagtgttgtttcatttcaactaattttgcttcattatagtctgccaacaataaatttctgccggcagcgacacgtcgaacaattgcttcgccgattgaaccggcaccgaaaagtacgattacttcgtcattcatattcattgacctctttacttgttttgattcaccttaacttacaagtcatatcttacaagcaaacgtcttttagaccaatttcaaattcagctcacattgataagttttacttatgaaaagcaatatcaggaaatcggccaccgctagatctggttttctgatattaattgtatctctaattgttttttgtaaaaatcaaatgtaagccgccgtcctctttgtactgtcgccactaacgtgtggtgcaatgactattttttatccgttatacttaacctcctttactctttgttaaaacaatccctcaaaaagagtcgcttcaataaaaaaggattgcccagcgccctactgaacaatcctatttaacatcatcagaatactagtaccatcaaaaaactgatgcgctttaagtaactaacactataattgcctgtcactaaccattttaggagtcagttaactggtcccattcacggcctgcttgggagatactgtcacgaaaacccacccaatcatctggattagcaaaaagttccgaattgattggtgtcataatcagtgccggaccactttgctcaattctataacgtgcccctacttcaaggctcagttcattgggaaaaatgattccctgagcattgccaatcttacgaatactcacttccatctatcagcacacctttccatcacaacttaattttcagttaatcccaacgacatgtcacggtcactttaccacgaagtcatagaagctagcaaacatctgatttgctcaaatgaacactgctttgataacaacggtattcaagacacaaccactattattcatcatcaacaccatcgccggaaaatgatactcaagacacaacaaaaaaagccctccataaccggaaggcctgattaatcaaaattcatcttatcactatcgaatcaccagtactgaaatcggtgcatgttttgccatatatgcggcttgcgaaccgaagtacttacgaacaccatgcttggcaactgagccaatgactagtaagtcgggcttcaacgctggaatcaccgtcttcacgatggtttcaccagggtcaccttcatcaacgaccgcgttaacatccgtcaccccgaagtcacgggccaacttctgatactgctggacgtgttcttccaaatccttgcgttggccatgaacaaaatctttgctcattgcttcatacacgttcatattatcctgttccaaaattgaaacgatggttaacttagcaccgtcactcttggcccggttaatggcataccgaaacgctaactgcgcgtcatccgaatcatcaacgccgactaagatgtgcttaaattccttaggactcatctctgacatatggctccactccccattctctgataatctgactacacccttattttcatcaatttgagcataattgtcaattatgactgcggtgcattttgtttcaagacacgcgccggattaccgactacgatgacgttatctggaaatgaatgtgttacgacagcaccggcaccaacaatcacgttgttgcccaacgtcaccccgggtaggatcacggcactaccaccaatccaaacatcattaccaatcgtaatcggtgcagtccgttccgcttcagtccgccgcacagttgggtctaatggatgcgcaggcgtgtacaagccgactttaggaccaaatttgcaatcattaccaatcgtaatcagtccttcatcacataacgtgaccccatggttagcataaaaatgattgccgatacgaatattgacgccataactaaattcaaaggtcggttcaacgaagaaccggtcaccggctgaacgtaagaggcttttcatcttagtattccgttcatcattatcagcaatctgattatattgcattaacttcgtccgcacgtctcgccgacgttgctgtaggattggtgattctaagtacaattcaccattaatcatttgttgatacgctgggtcattatcgatttccatgtttaacttccttttaagtatgatactttaagcataccacaccattcaaaattgctgtatgatggtttaaataaacctattgaaagtagtggttccatgcaatacgcaatttttgatctcgataataccatccttgactttgaccgtgctgaagcggctaacctcgcagccgtctttcagcatcatggcgtcactgatattcgccgtgcagaaaatgagtatcaggcctataacgaaactgtttggcaacaaatcgaacaaggtgccgatcgtgatagcttgttagaccaacgatttcaagtctttctaggcacactgggcatcaccgctgacggccctgcggttcaacaagaatacgaccaattattagcgcacagttatcaggtaattcccggcgcccacgaacttttgcgcacgctgaccaacgctgggctgaccttactcgtcggcactaacggtatcaaacacacccagctcagtcgcttggcaggtgcccatatgacgccctattttgatcatatcttcatctctgaaagtatcggttatgccaagccgaacccacactttttcagcgctattcatgaccgatacccagacatgaatgccacgaataccgtcatgattggtgatagcctgcgttcagacatcgcgggagcgaccaccgcccatttacctagtatctggtacaatccacagcatgtgcataacgacacaacaattgccccaacttacactgtggataactttaagcaactgcaaaaactgttattaacagcttaaacgcaaaaacaatcagcaaactctgcgcgcaggcctaacgtatcttaaaaactgaactatttaacatattaggtattatgcggagtagttgtatcgacggcttttaactcaataacctgcttaccttgatttccaatcaacaaaaagaccaattgacgaatcagcaagaaaagcaatttatataaaacagtcgtcgttgcttaattcaagattcggccgtgaaacaatgctaataacagttcatctgggtaagctgtcaaaacgtgccctttcttctcaggtgataagatttgcagatttaatccacttgacgcttgctatcaattaacgtgcgagaagaatagctaaaggaacggactaaaaaacaagttagatgcaaattctcataaaatgaaaacaccgttgcgctaatagtcgacgcttaaatttaaaagaattataagcgcgggtacttttaatacttgatataatatcagcatccatctaatttttttaaagattgtcaccgttaatacctttttatcactgtctaaagtatcactgctttgtgcgccgacaatcaactgctgtatctcctttattggacctaaactatccacaaacgcgattgcaaaagaagtgaaagtagcaagcttcataacataaataaccaaaagtatgtactgatcatcaggatttagaacaaatgtactaacaactaagaccagtattgatattattaggaacagttgcattatcaatcgtattttttcccaccttgtcttatttctttttttgagtttaactagacctaatttcaataagaattgtttttgatgctggattttcttatccataaagtacgttaccaaatagtacaaaccactgtaggcaaaaaatatgagcacttgtttgcatagcgtcgattggaaaatcagcatgagaagctcattcgaatatgaagacattaatttagatagtcctttctaaaattacctaagtattttagcttagatagcagtatttaataaaaaacgttgtgtctagatttctcattgaaatgaagcacaacgcttttggtattagaaaataaatgattatacgcctgaagaataacactattatgattcatcaggtcagacaagggttattgcccatgcacctgctttgacagcggagattaaattcaggcgctgtaagtggaaaacctgcattattccaataaatttcgataatagttgaaagtatcattgcttgatctagtatatagatagctgggaactaagaacacccgtggctaaatataataatatgtattgtgcgtatagtcgaaattcattaacataatctgcaaagcctattgaatgggcacactgcatctcatacgatataaagcaggtaatgttcacacttttatttaaccaaaatagcgtaaagacataagaattttcacgttcctcttattgtgcctatcggatatttccgtagctaagtgggcggagttaattgactagactcgtatcaataccattgtcctcatcaaaccgtataaacaataattaacctcaattaaaaaaagccatgcagccccattcttacagttacgacacagtaagaatcaggcttcatgacccataatacgattcaaatttaaccacgcggcgacgattggcaggaacacctgtcaattgatactcaccgcacggcccaatcaaagtgacactagccacaccttttcttacaaggtcagcactagctattttggttcaaaagtgaacccctttttacaatccactattcttcaatctgaacaaagtgtgtgttacctagtccaccgccaacttgcatgacactgccgccatgccgaagcttgcccaagttaacggggcggaaattcaacggccggacgagcgcagcgaattctttcttagcagcaacgtcatcgcccgcatagaacaagacccgctttccaggcccatcaacgtgcccatccataaactccggtggaatcgtattgaaggctttaatgacccgggcattgttagctgcacgagcaatgacttcacttccagtcaacggggccgtcttaattttcttaaagtcagccgtaaactggttcgtcacgtccaccacgatccgttgcttataatcggcgacctgcgctaatactgccggcgcctgttcaaacggcactgcaagaatgactaacggctgttgtaaggcttcagcaacttctacaaaagccacattggcagcaaactcggcgcgccgtgttgctaaactagccgcaccactgtgccgacttaatttgatttgatgatcaccgcgcgcaaaggtcttggctaatactgtgccgaccgtaccggcaccaataattccaattttcataactatcctccacctcatcttttaataatggtttgaattaaccgacttatctggtccgttatcacggactgtcagcggtcatctagaccaaaccagcttatcttaatgatagcgaaatcattatggaattgcaccccatacgcgtcaactatgcttgaacttgttggtaagccgtaataccagcttttaaccgtgccaatccatccgtcagggtagtcgttggacaagccacattcagtcgcaagaagcggttgccatcaccacggtaaacatctcccgctgataaaaacaacccggttcgttggcgaataaaagcagccaaagccgcactgtcggttgtcatttgacgcacatccaaccataatagataagtcgcttgggcctcaaccaacttgacttgcgacaattcagcggtcaaataagtctgaacttggcattgattggcggctagtttggtccgtaatgcggctacccagtcatgaccttcagtataggccgcaatgctggctggaatcgcaaacgaattgggctcagccaattcatcattgttgatgccccggctcactaatgcgcggacgtgtgcatcgggaataatcaacgttgccgcgtgtaaggctgccacgttgaaagtcttgcttggcgagatacagctgatactgttatgtgctactggcgcagtcaatgatgaaaatggggtgtacgtgtgaccgttaagggtcaagtcacaatgaatctcatcggcaacgactagcacatggtatttcaagcacagctcgccaaggcgttgcaacgtcgcacgcgaccagacgatgccgatcggattctgcggattgcataaaatcatcatcgtggtcaacggatcagctagtttcgtcgtcaaatcgtcccaatcaatcgcgtacgacgcgtcacgtgctactaagtcactactcaaggtatgccggccattgttttcaattgaatgatagaagatattataaaccggagcctgaactaacacgttatcgccagccgctgtcattttacgaacaattgatgaaatcgccggaacgacgccggtgcagaacatcaaccactcaatttgcggacggaagttgtgttccgttgcccaccagtctgccacggcttcatagtaagccatggggacttcttcgtaaccgaagacgccaaactgggcgcgttttatcaacgcttgcttgataactggtgccgtttcaaagtccatgtcagcgacccacatcggcaactcatcatccgcgacgtcccacttaacggcattcgtgtgccgccgattaagcacggtctcaaaatcaaacggcatggggcgcacggctttcatggtcaacactaatcagggtctgatgaggatctacttcaggatcatccatgatgatttcaccaatggcttgcgcatgaatccgaccactaagcggatttttaacgctatcaatcgttgaaaccacgtcagcgtcaatgttacgacaatattcaaaagctaagtccgtattgagtaacgtacagttttccaacttaacattatccatgtaacacaggccctgatcgctctcaatcgtacagttgacgaaccgaatattcttcgaattccagcccaggtattcaccaatgatttgtgaatcataaacggtaacattttcacaattccatagcgcatccttggtcatcagcgttgcatgatgaatttcaacgttcttagcaccgtcaaaggcgtaattaccaacgaggttgaagccatcaatgcgaatattatggctattcattccaaaataatcaccagctgcttgaacatcattcaacgtaatatcttggcagttccataacgtttcttccgcatctgaaaagtgaacgtgcgctaacttaacttggctggcccgccgaaatagcttaggtgcctgtagcgtactattcgtaatcgtaatatccttggtgtaccagatgccagagcgagacattgtctcaaacaaaccttgatccacagtcacatgttgactgtaccacaagggatatttccacttaaagattggctgtttcaacgtgacattgcgactttccttcagtggtgattcaccatcagcaaacgttgtattgtcgatttcaaggtcgtgagctttaaagagtgcccgctcgcccgttaaatactgttgtgtgattgttttcaatttaatctcaataactcctttatactgaaacgtggacctttagtcgcacgataggatcagtgtattacttcaactgcacgttaagtcaactaacttgttcgcttactgtccggaatactgattccaattattagttcgtgaccggttaagtgccatcacgccctccaagtcatggggttggtaaggggtttccaagtactgtatttccgaagcagttaacgccaaccccgctgcctcagccactgcatctaaatgatgcggcttagttgccccaataatcggcgccgttactcgttgttgtagccaggccaaattaatggccgccattgaaacatgatgttggtgggccagttcctcaacgcgatcaataattggttgatccatctcgctggtagcttggtatttggtatcagcaaacgtatcctgttgtcgccgagtagtctgggtgccaaaaggatgtgccaaccggccactagctaatggactatacggcgtcgttgccaaaccgttctcatgagcataactgaacagttcccgttcatcctcgcgatagaccaaattataatgactctggatcgagacaaattgtggataaccataacgaaccgctagcgcattgatctgcgcaatctgccaggaataggcgttagaaatcccaatgtaacgaaccttaccggcctgaacagcttcattaagcccagccatgatttcagccattggtgttaaccagtcccagatatgataaatatataaatcaacatagtctgtctgtaaattctgtagactctggtcgagggaccgcaagacgtgttcacgcccactgacatgattttcgatttcttgggttgtccgattcgtaaacttggttgccagtaccaattgatctcgctgaaatttctttagtccttgtcccaagacacgttcactcgcacccgcttgatagaccggcgccgtatcaaaaaagttaatccccagtgatatcgcgcgatcaagtacctggttcgcctgcgtttgaccaaccgcccacgagcgctgattaagcgccgttccagtccccgcaccaaaacccatgcacccaagtgcgatcgacgagacttttaaatcggatgttcctaattgtcgatattgcattgcatcacaactcccttcgttaactcattaccatctttattaaaacgcgatccgttggcagagtaaaatacctagttcaaataatcaattataaccattccgtatagttatccgtcatccagtcgttttaggaattaatgaccgttattagtcaccgacctttattttcagtgtgcctggcgacatcccagcgtggcaccgtactccaggtattgggccaaaaatgaacagcacgtttgcaaccataccaggccacatcctgcagtgagtgtcaccgaccgattttaaagtcgaaacactgataaaccggttttgggggcaccaccacaactcaccgcgaccacctccgccaattcagtttttcaacacaaaaccgaccattctagaagttacaccttttccagaacggtcggtcatgacaactgattgaatcgccgtaagcatcgctaccgacacgacgacaatgtttatttcagttttaccttaatttttaactttttaggcgcttgatggcgcgctaagattaattgccagcccactttaaccagcgtactaataacagtcatcacgaccattaacgataattttcgacgcattcggcatcacctcaattaatttaaatcgagcataccacactttaatcgacgtgagcggaattttgcaactgaatcatatcatagtagtaaccatgctgttgcaatagctcgtcgttggaaccgcgttcaacgatttgcccctgatttaagaccaggatcaaatcagcattttgaatcgtggataagcggtgggcaatcgcaatcgtcgtgcggttctcctgaatccgatccaaaccagtctgaatcatctcttcggtctcagtatcgacgttcgccgtggcttcgtccaagattaaaatcttagggtcagtcacaatcgtccgcgcaaatgaaatcaattgccgctgtcctgaagaataactggccccgcgctcaatgacacgtgactgataattctcaggtaaatcgttgatgaagtcatcggcctttacaaaccgtgccgctgcttgaacttgttcatctgaaatctgatcgttaaacattcggatgttggaattaatatcaccataaaacataaacggttcttgcaagaccaaccccatcttctgtcgcaattcctcagccggatactcacgaatgtcgcgatcatcaattaaaacttctcctgactgaaactcataaaaccgcatcaaaacattaatcgtcgacgtttttccactccccgtctgaccaactagtgccaccgtttggcctggttcagccacgaatgaaacgtcttttaagaccggatgctggccgtcataggcaaaggtgacgtgccgaaattcaatcttaccgcgcgtaatcttagccgtaggatcggcgtgttgggccggggcaatcgttggatcatccatgacccgtaaaacccgtgatccggcgacgacgccatcttgaaagtctgacaaattatccatcatcgacgtcatcggattatagaagttattcaggtacgtgatgaacgcgtaaacgaccccggcagccacataaccattgagtccacgaaccccgaagattcccagaaccatgaccgtccctaacgcataaaacaagtcgatcagtggacttaataataatgagttcgtccggatcatcgcttggcgggtcttaaaataggcatcattggtatgatcaaattcaccattgatgcggtgttcttgtcgaaattgctgaataacactaattccagtaattgcttcactcaacttggtattcaactcactgagccgttcccgcattcgccggtaaacccgtgagctataccgttgataataccaaatcgttacagccaaaaaaggcatgaaaaccaataaccacaaggcaatctgcgcatcggtgagatacatcgcgacaaacgacgaaatcaccgcaaaaaaggcggtaaataatgtattaaacaacgcccaaaaattggaaaacgacatcgtatcgttagtcaggcgtgacaaaattgagccaccagggacttgatcaaagtagcgcatgcccatccgatgcaacttggcgaacatttgtcggcggacattttcaagcatatattctgcccccatcgtactactgaagttctgtacgaactgcatcaacgcgcgcacaaccatgccgaagaaatacaggcccgcaaagtaccacatgaccggtaccgtggcgtgtcctgttttgagataatgatcaataaaggtctgtaatacacgcggcagatagatattaaccacactaatcagaccggaaaaaacgatggccgcaataaaaaaccatttgaacggtttcgcatacggcaatagtcgccgaataaccgtgagttgttccttaacaggcatggaacgtgcccataccgattgacgtgctgccattattgcaccgctccttccactttggtctccaattgctggcgcgtaaacatcttctgataccacccgtgttgcgtcattaattgcgcgtgggtccctcgttcaacaacgtgaccggcatccaacacaatgatctcatcagcgttcatcaccgaacttaaccggtgggccgcgataatcgtcgttttgtctgctcgttctgcctttagattagctaaaatttctgcctcagtttcggcatcaaccgcggataacgcatcatctaaaatcagcaattcaggattgatgagtaaggcccgcgcaatggctagtcgttggcgttgccctccagatagcgagataccttcctcaccaacttgggtatcgtaaccagcgggcatgctggcaatctgaccactcaaatcactcttggcggcgaccgcttccacaacggcttgactcacagtcggatcggcaaaacgaatatttttgcgaatcgtattcgagaacagaaaactatcttggggcacataaccaagggctggtaagtaactatcaagcgcatactgcttaatatcatgaccaccataagtaatgtggccctcgtactgatcaaattcacgcaaaatcagtttcataatcgttgatttaccagcaccaacccgcccgacaattccgagcgtctgtcccgccttcaaagtaaagtccacgttactcagactggttcctgcatcgttgggataattgaactgcttgatttgatactgaatatcaccatgcgggcgctgttcaatgccccgtttggcatcaataatggcactttgctgattcaataattccatgacccgatcatacgaggcgtttccccgttccatcgtgttgaataacatcccgaccgcaaacatcggccacaccatcattcccaaataagtgacgaacgagaccaagttaccgattgtgatgacaccgtgggtcacgtacaacccgcccaaaataattgtggcgccgtaagataacgcaataatcatggtaatcgcgggatcaaatagcgagtcgagtacattgacatgccgattgatcttaatcgtctgatcaatctgttgattaaaatcagcaacatcggccttttcctgacctaacgctttgatcactttgattccactgatactctcctgcgccttattattcagtcgcgaaaaggcggcttgggaggcacgaaacgcgacgtgaatttttttacccaaataccgtgacacgaccgctaataatgggaaaggcaccaccgcaatcagcgtcagtcgccagtcgattagtgtcatcatcgcaatcagcgttgtcccaccagtaataatggaatccgcaaattggagaatgccaccaccagcgacccgttcaaccgccgtgagatcattggtcgcatgagccatcaagtccccggtacggtattgctgataaaacgtcgcatccatcttcataaaatgccaaaagagtcgttcccgcagcgttcgttcaaggccggctgcaccaccccagatggcattccgccataaataacgcgccaggtactgaccaacggcggccacaccaataataactaaatagaccgtcagcgtgtgcgccgtcaagctgtgctgattaatcccatcaacgacgtccccaataatccggggtggcacaatgccgataatggcagtcaaaactagtccaagcacccccgcgaggtacaacttccattcacgccgaaaataccagcctaatttcaaaaatatactcacagcgcacctccaataatttaattaaaatttaattagacaactttttataataccatacctcgcgcaaaccccttaatgataagttccatcccgaatgcaaagtgattgcaccagattgaaaataagcttaaactggggacgttagtggggcggtcattacgatcgtcccctttcaatcgtaaaaattcagattactgatttttaccaccgactattgggcttggtgagctgtccaaaatacgccaattatttttataaggagtgttgattgtgtcccaaccaagtaccgtcactttaaaaaccaaactggcaatcttatccgttggtttactctcatttgtcgggattctcgtggaaacatcgatgaatgtgacgttccccacgctgattaaaacaatgggggtttcactagataccgtccagtggctgacgaccggttacctattactgacaaccattgtcatgagtaccacggcctatgttctaaagcggtttaaccccaagcccttattcttatttgccgccctcgtgtgtctgcttgggggcattctttgttggttagcgccgaatttccccatattattaactggccgccttttacaggccgtagccactgggatttcgattccactgatgttccagttgattttcacttacgtccctcgcaatcaactaggaacttataccggtttagctagtgtcatcgtgtctctagccccggctctcggaccaacttatggcgggattttaactagcgtctggtcatggcgggcaattttcgttggtatcgtaccgttattggcattactggcaatcttaggggcgttcaacatttcggggaaggccttaggtgttggcgataaaaaattcgactatctgggcgcaatccttttagccatcaccttcactagtctgttgttcacgtttaacaacgcgggaactcacggctggctgtcgccgaacttcggcctctggtgtctgtggagcatcgtgatgattggtgcaatggtgacgtacgccatcaaggggcgtcgccaactgattgattattcaattctcaaattgccaatcttgcgacttcggctatttaattactttggtttacaattcattaatatcgggttgtcgttcgttctgccacttttcgcccaaaccgtccttggggcttcggccatgacggcagggctcatgatgcttcccggcgcaatcgtcggcgccatcactgggccaatcgccggtcgaatttacgataaacaaggcccaacgaccttattaacatttagtgccatcatggcgagcgccgccttactattattctggctgacaaccgattacttcacagtcatcatcatggctgtcatttacgcgctactacgcgtcggctttaatactggttttgggactgcgatttcggatggtagcacccgcgtccctctgcctcaaaaatccgatcaaaactcgatgttcagtatgatgcaacagtacgccggttcaatcgggaccagtattatgtccgctgtaattgccggctatgaaattcatcacccgaccgtaactggaacaattatgggaagcaagttggatttcttgctattattcgtgttggcgatcgccattttgattagtgttctgcatgttaaacgacttgaaataggacaaaactaggattgactggtagcatcgttagtcttgcaagtggattgattgctgcatttttggaaattaattctttaatactttgaaactataccaaaaaggcccgggttagcgtacccgagcctttcttgtaccatataaaaaaccatttaccaactaacgcctaacttcactaataccaaccgcacaacattttcgttttggcagttacctttttaacacctgaacaactccgaatgcagcaatcgactattattttctagataggttattctagtcattcagcaaatcgtcaaacttaggcttagccactggcaagacattagcaccgattttaatactttcagataacaaccggaaaaagtcagctgtcataattgtttcatgacaaagtaactagcacaacgcgtattggataaatacataaagctgactgcatagtcggctttataccgttgcgggcaaattattacggttttagtgaacttgcataaaatagtttggaccaggtactggattgtcagcctcaaagtaaagaagaccatggaaggcggcgtggtaaggaccgccacttggagttgctgtaaaatactgtgccacagtgcttagatcaggacgatcagtaatgtaccctgtaaaagcaccctttttttctgaaaagctaacgttcttagcgtttccagttacaccacccatatatctgccatagcgtattcttgaaccagaaaatttatttacttggcaagattgccctttacccaatcgcttgacggctgttggttgtttcgggacccggtcttcgataactggttcttgagatgatgcatcaaatagcggaacctgattgccatctttgtcataaatcacgctttgctctgtaaaagtactcgagttggcatttacaaaatggaaaaaaattgacacaatcagccctacagccgataacgatagtgcacgtaacacagttaaactaccccttttcataatacgttacccaatttttaccggtattatactttgtccttatatgatagcataggataatcatatgtcatctattttttcagatatttagctttaaaatattgatgaattttatccatcgacaccatttttatgtatgataaaaggacatattgcgccatgctgcaaccaagctgatcacaaccaattgaaagcatgtgtccaatatgtcccaagataattctactaaattactgatatgattattcaagaacgattacatatcgctcagatcaatatttctagcattggtgaatgaatcaccataacgtcaaagtgtattgaaagtggattgattgctgcatttttggagattaattatttaaatgctttaaatctacatcgaaaaggctcaggttttctttgacctgggcctttttgcgtactctagcatcaataaacacactattaagcagattactatctcaatgctttctaaaatagagtttccatattatgatgctataattgaaaactagtgacattacaaaataaataatggaaatacccaaaacattagcacagtattctgtaaaccaatatttgtattgtgtgagaagatcatatccaccatgtaaaacaaaaaaataaataactgatattccaaaaacaatcatgctttgtttgaaacttgatttaaaaacagccatcatatcctactcccatctattgaaaccggtttcgttttgtcttattatacatacgcaattcaaaaatgtacactaccggaataaggaggaagttcaatgaattataccagtcaagctaacattcacaaatttactttgatcattattttattgagcagtatcctaatatctactaccataactttgaaaatttctgccaatacgacgtcatcgtcacaacaagccatagattgtatcgctcaagaattagcagatgtatcaaatagcattcggtatgatccccagactggattagcaacaaacttagatgtgaacgctttagtatcaaaatacggttccaataaccagaaccaattgcagcatatcaacgagataatgaaatatgaatacaagcgaaatttgcaattcaaccaaggcaagctaaatagtattcaaactagaagtttttggtcctgtatgaaaaatcaattattggacatgattggctaccaaactttccaagcattattacgcggaggcattcaaggattaatccaaagaaaggcgtggaaggcagcggctaaattactaatcagataccttggagatggcatcggagtcgggtttatcgccgcacaattggcctggtacgcgattagatgtgcctagttattcattagttgcgctcactcgtagaaaaaagtaatgtcttcgaattatggtatcagtaaaattaaaatttaacccttttcgagaaaaaaaccgcgcccccaagacgcggtttttcgtcttggaagcgcgataatatgattaccagtaattacttaccagctttcatctgaatttcagcctcggctggaacttgcatatcgtgttgcttgaggaagaccatggaagcccacagtaatcccagcgacacaatcgtaattcctgctaagacaacgattgatgaccagaaaataccactaccccaaccaccagttaaggcttgccggaacgcttgaatcgagtacgttaatggcaaatacgggtgaatagcgttgaagaacttgttggtaatttccattgggaaggtcccaccagaaccaccaagttgtagcatcaagataaccattgcgacgaaccgtcctgggttatcgaatagcatcgataagaacatgactaggaacattgacgctaaggcaatcatgattgccgtcaagtagtattcaggtacactgattggtttcaaaccagcaactaataacactgtcgcttcgatgaccgccatcgcaagtgctacgggaccaccaacagcaactttactccagaaccattgtgttggcgtgccgtcgtcatccgcaatccgtcgaattggataagcgaagttgaagacgattgccccaacatacaaagccagtgacaagacgtaaggtgctaacgcatgaccatagtttggcacgtgcgtgtagtctttataggacgtcttagttggcgccgccatcattttcgcattcgcgttctttaatggtgtcgcgttaacttgatccgcaccttcttgtaaggaagtcgcgagtgtcttgttaccgttcttgatctgctttgtcccggataggagtttggcagagttgttgtcaagctgggtggccccgtcatttaattgactgacaccactcgttaattgaccagtactaccttgtaaagtttgcaagccactgtttagttgccccgcaccggtgtcaagttgttgaacaccacttactaagactggtacttgaccgtttaacgttactaaaccatttgtgaccttacttgaaccagcaaagagttgttgaacgccactagccagaactggtacctgaccgttgagctgaactaacccatttgtaacctgacctgagccaccggttaacatgctaattgcagaaactagcgttggcacctgcacgttcaaagcttgattgccagcggccacttgatttgccccgctgttcaatgtactagagcttttatttagttccgtggttccattatttagctgagcaatggcacccactaaagttgggacctgaccatttaacgcggttagtccaccttggattttgcctgcaccactattgagatcagcagacttactattgagcgcagtcgttccttctgaaatctgtcctagaccagaagacaagtctgtggtcttacttgataagtttgaaatcccagaggttagccctggtaccgcctcatccaattgagttagcccagtagtcagttgactcgttccggactgaacctgctcaagactatcggttaattttgcagaaccagcttgaagcttttgaatttgggccgctaattgattaacagaatcaatatacgtattcacaccactttgcaacttttcaaagctttgtgccaaactagcatcgactgtcgttgctttagaaactgttcccagtgttgtctgaacttgcttcatcttggcattcaagtccgtagctgcttgttgtctagcagtactatccgagttgcctttaccaacactggacagtgtgtcttcaagcgctttaacttgagcatccgttaaatgttgtgcatctttaatactttcaattttagtattaatttcagcacttacattgctagtatccgtggatgccgtcaaagtagctacatcgttattaatcgcactatttaaagcagaaatatttgctgcgttagcattgccctttaaatttgcaataagtgcatcaacatcttccaatgttgacgccatcgcagtcattccagactgtaacgttgcaatctgctttttttcactatcagatgtcgccacgctatacaaatctgagagtccagtcgttactgtactgctaccgctatgaattccttttaacgcattattgacatctgttgctccagatagcaactgagttgattgtgcttctaaaccacttgttgattcttttaattgatttgcaccttgactaagcataccagcaccattagaagcggtctttagtttgccgtcaatcttattaacagcactagtataatctgaaacaccagtcttcaatgttgaggaaccgtctttcagcagcggcacagcctttgacaattctcctgtttgactattcagtttgcttaacccttgcgagacagtgtaaacaccgccagtatattttacaattcctacttgcaaggccttagagccgtctgctaacttaacaacaccatttgataatgtaccagtcttaccattcaatgtcatcagaccattacttacttttgctgatccagttgccaactgactgacaccactagccaacgccccagtcttaccattcaacgtcccaagtccactagtaacctgcccggaaccatctgataactgactaacaccactagctaacgccccggtcttactattcaacgtatccaaaccggtcttcaacgcactaccaccatcagcaagcttagcaatcccagcaggtaattgctgcactttcgtattcagctcagtcgtcccgttcttcaacgtatgaacgcccgtcgtatacgtcgtcaagccatcctgcagttcgacgccaccatctttaagcttggtagccccatcggcggctttttgatagcctttaccggcagtccgaatctgcttgaagattgctaatgcgtaggccttagtgacttgcgcccgaatactcttattaactcgtgaaacaccagtatcggtaatgactttagcaatataattcaacgattcgttcgtctcataatgcaagttcatctttttcggattggtatccgtcatcgttgtggcattttttgagaaattgctaggaatcgtgacgaccgtgtaatatttccggtctttcaatccctgcttggcttttttagccgacacaaagtgccaatctaaatcgttatttttctttaaattcgtcacgacttgcttaccaactgcaaacttttcgccttgatagttcactgacttatcttcattaacgacagccactggtaagttttgcgtatccccatatggatcccacaccgacttcaagaagaagatgctgtataaaaacgggatcaaaatcatgactgaaactgaaatccatagtattttgctatgacgaattgaccgccattcgtcgcgtatcattttcacaacctgaaaccttccttcaaataattaaactgtgtgttgctcaagtgaaaacaccgtcgcgagcgtcccctgaatcatcgcctgcgtgctggccgcctgaccatcacgatgaccgttattgagccactggacaatacttgtgacgaccccactgactaagtacgccgtcaaatcgggatgctgcgactggcgaatcatcgcaaaaacccgatcatccgcacccgtctcggcgaccgtgacaaaacagtcattgatcacttgttgagaacgggtattgtcaccctcattgttcgtcactaataaatgtcgtaaaacttgcgtgtgcgccccgataaacgtcgacataattgccgaaccaaccgtatcagttcgctcagcagccaatagttcatctaacgtgtgcatcaccatctgcctgagcaaatcaaatttatccgtataataacgataaaaactactgcgatgtataaatgcttgcttacagatctgctcaaccgtaatttgtgagattgaacgttgctccaacaattggtacatcgcccgctgtaaatccagctccgtacgaattgaaattaccatcaccccgttttttaaattcttatattcgaatagaagaatatagttaccataaaaacaccgctgcatccccgtgcaacgattgctggtgttcatgcagtttagtgcaagtacggtttcaattccaagtccgccttaagcgtgtgaatcaaatgctcaacttgcgttagtggcgcgtcaaacgtcacccggtaatagttacgggtcccctgatgttcaactgcgacaaagtgtcgttcctttaacgtcttcaattgatgcgaaacggccggttgcgaaatatgcatccgttcagttaactcaccaacagtcatgccctgcgcgtgttgcgaaagttcaatcatgatttgttgacgccgttcatcggctaagacttcaaagatcggaattgtttctcgaaattcttgcagtgcttcttcactactgaccatgcgattagcctcctatattcttatattctaatgttcgaatgtatcaatgataaagctttttgaatccgtttgcaacacctaaatccactttgtcgataaacgcgacaaattattatttttgtcgcatttgacgcaaaaaaagacgcctgaccacgcagtcagacgtctccaagggtaattagtactagcaatcaaaacgattgatagcaacgtccggttgggagccggagccgttgtatggaaaatcataggtgtttgggaaggccccatgatctaagacatcgcgttacttgttaataatgacagaaacatcagcaaattaacggcggttaagtaactcgaataactacagtataatcgctccgtgaaactttgctagtcctactttgaaccttttgtcgtaaaacaggacatttagattaaattgttgtatgaaaaaacgacgtttaacagccgaccgtgcccattatgctgacctagatgactgtcttgccgcttaattcaacgccttcttcacatatttgtaaccatacttaaccaactcgcgctcgacttgcttactagtggtcgtcgattgagacgagcgactcgcactcgtattctgactactgctgactttgtcagccccagcaacctgcatcgtcgaatccgctttcccacgaccagtagcatagtcgaagctaacgccaggctcaacgttccaaatatagacattgaaattgacactgccatcggttgaaactgcttgcgaccagtaaccacgaggcatcaattcgttgccacgaaaaaccgtcgtcacacgataaatgacttttttaccttgttctaacgccgtacgcacctgatcttcataaatctgcatcgttttttgattcgagtaggccgtctgagttgccaagtttttcgggttatctaagctaccatcttcaccagcgcgatactgcccattagacgtcaagttaaaggataacgtgtaagcaatcaagtgcccgcgattttgcggatagacccgcttaccattaacggtaagcggttgattatgccagccagttgggctccacgtttgcgccgtccgtccttcagaccgtcctaaattggccttgctcaagtaagccgtgtccgtggttgtccgattcaatgaatctaaattaccgtaatcaatcttagaatttttccactgactcgctgccagcgtactcttaccgctattaactttgatggccgcagcactgcccgattgataagtcatttttgccagttgtttgtaagtttgttgcgtattaccagtcgtactggtcgtttgattacgactggattcagactgctgactagtcgtcgaactcgtcgtatccgtaccagacgttaacaagctacaaccacccaacagtaagctcaaactcaagagacccgctatgccaacgcgtcgcattaatttcaccatgattctctttcaccccgtcttttttaagtacggttctatcataccgtactttcacaaggggaacaaacgttttcttttaatctttttgtacttgccagtcattccttataatcccatacttgaccgagtcataatactgcccttgccaataacgaacttgtggaatccgagcctcctgctttaatcccacggcttccgctaaccgcatcatccgcgtattccccgaccacgttgtcaatccaatgtgcggcaaagtcgtctcctcttggaataagtaggtcaaccatttagtcaacgcggtgcgcccaatatgctcaccccaatgctcctgatcatagataatgatgcctacctctaaccagcgtttgagggaaccatccacaaagtgccaattaacactgccgacaatcacaccatcccgtgtgatgacccagttacgtggttgaatcaaccaatcacgggggccaataattgtctcaaagtctgtttgagtcggtagttggtcatgaaaatacggtccattccagcgcgtccactccgcatctggatcactaaaacctagttgccatagcgtcgttaattcttcgcgctgaagcggtcgaattgtaattgttgccgtcatttgatcacgccctctcaattcataggcctactatatcgaaaaaccaccctaacaacaatcacattcgtggacatataaacttacattaaacagccccttttccagcgaaccgaagctggccgtccttgactttagctcacttaggacaacgacagctcaaaaaaaccaccattctggctgaaagaatggtggtcataagtcttaagcgtgtgttgcaagctgtcgcaacaattttagtatagctgctgaaacgcgtttcaggtcaagcactaagttggcgccaggttgctttggtcagtaagtaccgcatgacgtggatcacttcacctttatcactggtaaacgtgtgcagttctccagccgcttgcatgcccatcttagccatcactcggccagaattagggttggcactcgcatagtgagcctcgatggtctcatagttcagcgtttcaaacccataatgcatcaaacaattgccggcttccgcaacataaccgtgcccccacgcagctgggcttaaagcgtacgtcaattcaccagtcgcaccactaccatgaaactcataaaacccaatcagttgatgatcacggcgacgttcaatgccaaaaacagtggtcgtgtctgccaaaaagtgcgtcgtaaacagttgctcgaacgcggccggactctgaacccgtcggtaacgtaaataagcgacaacctgcgaatcaaaaagcatgtccgctaacgcatcatgatccgccgctgtcattggtcgtaatatcaaccgttccgtttcaaactgagtcaaattgccatctccaaattattattgattcgttaattataataatctactggcaaatgtaaattatttcgttccactctcaatgatttggcaaagtcacctgtgccagcatcgcagttcctaccgcttcaaatcgggggtcagtaatctgattaacgtacgtaaatatcccagtactacattgtaacagtaaccactgtgtcactaatggtggtatttgtaagtctgtcccataaccagcccaaaaagcttgaatcaacgttgcagattgttgaagatcttcaaaaaagaatttcaaacagtcctcgagggcgtacccgtgacgggctcgttcaaaatcaatcagaacaagctgaccatgatggtagcgaaagttacgagtacccatgtccccatgcagtgtcatgactggttgcggtgctagtgcggttataatcatcgtccggtggtcgagaaagtatggtaataaggacaccagcgcgtcgtaatggggactagtctttaaccgctcaacccgggcggccatcccatcgaaatccagaaccggcatcaggtctgcggttgttggaagttgaattgcgtggtgaaatctggagactacctgacccatttggtaaacgagcgctggagtcaaagttgtcggtacaggagttagttgccaatctcgcaacaccaacacccactcgcgacttgctaattgaaaactggctaagacccggtctgtgagttgcgctgtcacttgctgctcagttctaaatttacgttcgtgattcggactgaaaactttaacaaaaactacggtgtcatagcggcgactatagccggtatacatctgattaaatgaaacatgcgcaatcggaatcaagtctgcctgtaataaccgtgttaacgttttatgcagcgttctcatttcgtcctcctaaatccaattctcgcaaattttaaccacaataaaagggccggtaaccaaccgtccctttctctgatcgacttgcaaaccccaagcttgccattgtgtatgtgcctcgtcatggacccagcccatcccgagaggtataaatgcttgtcaaacgttatgattcagctaactgagctacttatcactatcaataattgcttattaacaatgtcctgacaaagtaaatcgatccggctcccaacctaaatccgctgacaaagcgtatgtattgcttcataactttgtctttagtatagcgagccagcattgcgtttagataacacgaagattacaaaaatgttacaactggtctaaaccaactaaaagttagcctggtattgcttaatcgtctctggctacggacacccagtttatctttaacgaacaaagtcgcccactatggtcttaacagtcggcctttattgagctgaaagccgttgattgacatgtgcttgaataacttgtcgccgagaaccggtcaagaaataaatcgttatgccaacaaaaataatgacggtagcaccgattgtttgccattcgaacacatccggcttaaccattgtctggctacctgatgccatcatgctcaaaatatcaatagcagcatggatcaccatcggcagcaagatactacctgagtataggtacgtcgaggttaaaaaccagcctagtgtcgctgcaaaaatgatttgctcaaccgtggctgacaagggttggcccgcaaaaacgtttgtaatatgccacattccaaataggccaccgcttagccacactgcccagtcgatctggtagcgccgatgccgaaaagcttgtaataacaaggttaaaacggcaaaacgatacaaccattcctccgcgattcccggttctaacccactcaaaaacattttccaagtcgctgaccgtagctggaagtcccaatgtgtgaacgttgtcgcccatgaaccacccgcactaaaggcattccatagactaaaagccgttcccaccacgatcagcccaaccactaaactagtttgggcctgacgattaaaccgccacgatgggcccgtcaatccccatccccgcagtaagaccccaacagcaatcacaaagcccagggcgcctaaaataccagtatcactgaccatctcgaatactgatggtgcttgcagattcggtaaaatcaaaaaagtctgctgcgcactgacgacaccactaaaaatagccgtaattaggaccgcaatccggccaatcacagattcgatcggtttagtgaccaccactgccaccggtacgaatgcgaccattaaataagccatccccacagcaatcaatccctgctcgtctaaccatgacagctgacttaaccaagccacgacgttcgccagtaaaatcggcaagagtgtgaactgcagtactgtttggacataataattaacatgtcgcaaacgccgccactgtgcttggtcctcctcggcagctggccaccaggctaacagtccccatatcagcaactgcataccaccaactgggaaaaacacaccaccatcaaacgtaaatagttgaataaaggccgcgccaaataatacgatgagctgccccatgtaccagcgtcgtaataattgttcggtttccggcgtcataaaaaaatcccccaatctgatatgcattaatcataccagattgggggacgctcacacgtgattttgtttagatttatcggattccacgactaactaataaagatcttgcacccggccctgtgttgcttcatgggccaagtattcatcataagtcgtatcaccacgatcaacaacgcctttcgcactcacttcgacaatgtggtcggcaatcgtttgaataaattcatggtcatgagaagtaaagacgatggcgcctttgaaatcaatcagactatcattcagtgcggtaatggattccaggtccaaatggttggtcggatcatctaataataagacgttagcccgactaagcatcatctttgataacattccccgtactttttcaccaccagatagcacgttcactggtcgttcaacatcgctaccagagaacaacattttacccaggaaacctcgcaaaaaagtattgtcactttcttctttcgatgcaaactggcgtaaccaatcaataattggcaattcactacccgcgtattcttcattaatatctttaggcaaataagtccgcgaagtcgtttgtccccaggtcaccgtgccactatctggtgccatcgacccagcaataatttgcatcagtgttgtcgttgccaaatcgttgcggctgatcaacgccgttttttcattgggacggagcgtgaagctaatgttatcaagaatcttaacgccttcaatcgacttggagacattctcgaccttcacaaggtcattaccgatttcacggtctggcgtgaacttaatgaacggatatttacgtgatgatggtttgatatcatccaacgtaattttctccaattgtttcttccgtgaggtggcttgcttagatttcgaagcattggcactgaatcgcgccacgaattcttgcaactctttaatttggtcagctttcttggcattggcattcgcttgcaacttggccgctaactggctagattccatccaaaaatcataattcccaacaaatagtgtgatcttgccaaagtcgacgtcacacatgtgggtacaaacttgatttagaaaatgccggtcatgagaaacgacaatgaccgtcttttcgtaaccagccaaaaagtcttccaaccagctaattgattggacgtccaacccgttcgtcggttcatccagtaatagcacgtcggggcttccaaacagcgcttgacctaataagactttcaccttttgcggttcagttaactcgctcatcttcaagtgttgcatcgattcatcgataccaaggttttgtaacaactggtccgcttccgactctgcgttccagccatccatttcggcaaattcgccttctaattcagcagcccgaatcccatcttcatcgctaaaatcaggcttggcatacaacgcatctttttcagtcatgatttcgtataacttttcgtgaccacgaataacagttgctaacacttcttcatcttcaaaagcaaagtgattttgattcaagctagacatccgctcgttaggccccatcgagaccgtcccagtagtcggttgtaatttaccttccaagatttttaagaacgtcgacttaccagcaccattggcaccaataacgccgtagcagtttcccggcgtgaattttaaattgacatcttcataaagcttacgtgttgaaaactgcatactaacattatttacggtgagcattccattacctcttcttttttaaagtgaaattgtccgatagaaaagaggtcggaattaaacaaaccttccagacctctgtgtcgttaattatataactttaattttagcatgctttcagctcgtttggcaatcaaaaccatacgtgattttctgaaagcatctcatcattttcataaacaatccaaattaaccccacccgtaaacaccagttttaaccatgtctagtgaacaggcttgcgcgaccaaagccccgtctgacgatcatcacgcacaccaagtaacccaagttagcaaaatactggtctcacaaagttaactcaaaatatgttgttcaatataatccaatacaccattgtccacattggtacctgtcaccgctgtcgcattggcttggacattttcaggcgcgttttgcatggcaaccgcatgggtcgcatagtgaaacatctcaagatcattggtgccgtcgccaaaaactaacatctcatccggcagaatacccaactgttcaccaagctgtttgagggcgcggcctttgtgcattcccggctgaatcaagtccatactgccctgaccacctgaagcgggtacggcaatgccagcgagcttaggggtaagttcatatactaactgctccgtcattgccgcgggacaaataacgtcgaacttcacaaccggatcagtaactgtggttaaatccgcacatgtctctaattggtaatagtagtcacgcatattagctacaaactgcgggttcgcgtgcgccaacacatggaccgtttgggtgccacacaatgccacttgtaattcaggatacggtgccagggccgctaacacttgctgagttgcttggggactgaacgtcgcagctttgagtcccgcttctcgttgccacagttccgcgccgttaccaccaatcaaccacatttcagggtaagcactaaaggtcgtggctagttccgccgcttggtgaccactggcaatcacaaactgaataccgcgctgctgtagcgccgcatagtcgttggcaaaccgctcctggtcataatcaccatgatcatttaaaaacgtcccatccatatccgttgctattaatttaatcgtcattactaatcatccatttcatgtaagccttttctaccccttagcctaccgattatgcccgcaaagtacaagtcttttctgatactttgttagaaggcaccaccaccggagccaccgccaaagccaccagaactaccgccggagaagcctcctgaaccacccgacgccgaactagcgcttccagaggcatctaaggcgccactaaaactatcgttgattgcaccggacaaatcgaagtccagcccaccattcgcatagaagagtgggtaatacacgagcatccccgtagccaatgcttccgtaccaaaatcaatcgccaattgcttagtcacttgattggctagtccaaaagccgcggcgtatggcaagatttgttcccacaaaatcaaatcaccgacttgggccgtattaaagtgcccaatatccttaagcatgcggcgtagtccattgatttgattacgtaattccaagcctgcgtcagtattgatggcaatccgccgccgttgaattatccagccaatccagaaagccaccgcggccactaccgctggaatcaccatcagggtcacgaccttcggactaactaataacccagcacccgtggcaatcatccccataacactcacgacaactgctgccatcagccattgattacgaagccgataattagtttcgtcttgatagaccgccacgtcttggtctacttcggtctgccagcggctaaaccatttgcccaaccgaccagctttatcacgcttcccgtattttttgagatccgttaacatgaactgcccgtcaaccgcgattttatcaaaacagtgagccaaaaatgagttagtcactggtttcaattgcgttaaccgcacatccggttttcggtgacccgcaaccgtttcaatcgttatttcttgattagctgctgctcgcaaaatctcagccgttaaagcatccgtattcggcgaccgctgtgcccacaatgactcagcaactgctggtgttactggtggcacgtcaaatgaatgattgatgggaatcggctgctgatgtggcttagccggatgacgagccagccaccaaagatagccaatcatgaccaataaccaaccagccactgcggcaccaaagataacacgacgcagtaactgattacgtcgccgtttttcattagcttcctgtgccaacttagcttcttgtttttggaccgtcgcttttcgcttggcagtattcgtccgcgtattcgtcgccgtgaccgtggttggaaatagtaggtgactttcaacgaattggttcgcgggattatgtcccaacgtcatcgtcacccggcctgccgcgcgctcaactttcgtctgaccactcaacggtccgtgcgtccaggcttgtaacgcgctcacattcttggcaggtaactgaatcacgattttgacattattcagtggtacatcccagccactaccaatcactttccaattcagttcggccgtgtctgcatagttcgttacgacccctttaagccgataccgatagacaacccgtaacttatcatcttcttgaacttgccggtagagcttgacacgcatccggtcagcattttgggtcaactgatacgtgctgttggcccccgtttcacttggcgccgccgtcaccgtggtcccaccattcagttgcgtcgtgaccccttccaactgggccccctgaatacctttcaaatcttgaacattaaataccccatgataatcgtcatcaaattgataagtcatcgcttgcgttacattcgcactaccatcacgttgaatggctacattaacttgatattggtcaatatcataatccgcagctgcgcgcattgctaagctaaaccaccaacaaaatcctgccaatagtccgagcacgctcagccaacttaatcgtcgcttcttcgacatctcaccatcgccccctccaataatcgttagccctagtttatcatactcccccggccgtggggcgcgagatactgccaccgctttcttaggcaaagccgtccttttgttgtagcatagaaagtgacacgaaaggggttttagtcatgccacaaaccacgttaccgactcacattcaagtgcgaggcgcacacgtcaataatttaaaaaatatcgatatcgacattccactcaacgaatttgttgcgatcactggtcgcagtgggtccggtaagtcatcactcgcaatgggcgtcctgtacgctgagggggcccgccgctacttgaacgccctgtcaacctttacccgccgccgaatcaatcaggtcggcaaagccagtgttgattcagtacaatacttaccatccgcattagcgctacgccaacgcccccaggttcccggcgtccgttcaaccgtcggcaccatgtctgaaagcttaaatatcttaaggctagccttctcacgactcagctcagcagtttgccccaatggtcaccgcatgccaccaacgctcgatgtggctgaaaatgatggttacgtcacctgtccgacttgtggcgccaaattcagagcgcccggcgccgaagatttcgcattcaattcaggtggggcctgtccgacttgcggtggcctaggccaagttcgccaaattgacccggcactcattattgcggatgaaaatcaaactatcgaagaaggggccgttgcttcttggcacctgcctggacgtaactttatgccgatcgttgcacgcgaaattgggattcccatcgatattccgtataaagaccttagtgaagccgataaaacacgcgtattgcatggtcctaagcaaaccgttgccatcaacattccaagcgctaaaggtaaaatctttcacatggacaacgctgtctacgagaacgcctttgccgccgttgaagatagtatggcgacgaccaaaaatgaacgggcaattactcggctgaatcgcttttacaagtttgatacttgtccagattgtcacggatcacgcttcaatcctcagttgtttaactacgaattaaatggtcaaaacattgcgacggttagtgatatgactgtcgccgccttgcatgattttgcggccacgattgtcccgtggctacctactaagatgcatcatcttggacaatcccttgttgatgaattgctactcagcctgcaacccatggaagaacttggactcgactacctcacactcagtcgccccggcgcgaccctgtcaactggtgaattacaacgcattcagctcggacgcactttgcgtagcgccacgactggcgtgttatatatccttgatgaaccttccgttggacttcatccagctaacgtggcgggcctaatcaaagctttccgcgggctagtcgcccaaggaaattccgttgtggtggttgaccacgacactagtattatcagtgcagctgatgatattattgagattggtccgggggctggtaagcacggcggtaccgttgtcggacaaggcactgtcgcagccatcaagcagggcaaagagtccttaattgcgccatttctcaccggtactgccacgctgcgtgaacgccccgtattaaccgacgatgcgctctggaaaaagggggcccttgctattgaagtggctcatcactttaacatccaagacattacggcgcgcattcccaaaaaccgtttcacgaccgtcacgggtatgagcggcgctggtaaaacgactctggtactagatagtttgattccagcactgattgccacagctaaaaagcgaccactcccaacccacgttaaggcctttgacaatggtcacattcgacacgttgttaccgtcgactcagtgcccgttggtaagaatgtacggtcaacggtcgccacttataccaacattctcgaccatctacgccaattattcgccgccaccccagcagcacaagcaaacggttggaccgctagccaattttcatataacgtcgctgcgggtgcttgcccaacttgtggtggtacgggccaaatctccttagatgtgcaatacctgccagacatcaccgaagtctgcccccaatgccacggcaagcgctacaataaacagacgctgaccgtcaaatggcatggctattcgattgcggatattttagatctcgcggttgacgaggccctaccaattttcaaagcgcaatccgccatcgctaatacactccagattctgcatgatatgggactaggctacttactattaggtgaaagtacgccggcactctcgggtggcgaagctcagcgcctgaagctcacctcccgcattggcaaacgccaaacgggaacgctctttgtcttcgatgagccttcagtcggtttgcacccgctcgacattcagcaactcgtcaaagtctttgaccaactgattcagcaaggggcaaccgtcattgccatcgaacacgatctcgacgtaatcgccaacgctgattacgttatcgatatgggacccgcgggcggtatcaacggtggtaacattgtcgccaccggtaccccattagccgttagtcaaaatccaactagtgtaacagggcaatatttgaagacgcatttggccctattccacgtttaaccaatgaactgatgaccgacctcattcatcacaacggtcttatcgaatatttaatcaaaaagcgtgtctaacccccagctagtcaacttgctaggggttagacacgcttttgttatgctgagatagtgccaatgaagcggacgaaactaacgtccttttccttaatgtaccatttcagttagtcagccgtcccaagatgtctttttgagcactgcatttcactaaatccattcgtaagtcatcacaaagctgatagccacatcctaacgccaaattgaaatatcaataacaaaagattaacaattaatcactgccggtgcgccatcactgcccagatcaacgccagcgcactcacaccaatcatcaccgaacacgccgccggcgcaccaactaagttatataataaaacgatgccgacgctaccaatgggtgccgccaacgtcacaatcgaactgatggtaccaaagaccgtccctgttaagtgcgtgtcaatttgtggcatcatgatggcgaacatcttcgggtccagtttgccactcatgaagcccactgcaaacatgcccccaagaatcaagattagttgtggaacgactagtaaagtcacataggtcagcatcggcgctagaatcgctgccagtaacaattgaaacaacgagagccgatcaaaccaagtatttttagtaatgccacccaatacgctcccggtaacaaagaccacgttgaccattaaaattgcgaccgaatagctcacgggcatgcgggacgccaagtcaataaacattaagttcaaaatcgcatcaatactcatcgttgcgacgtttaaaatcatcagaatacccagataactgactgcgcccattctagtcgtcgtcagcatcactcgctgaatcacaggccaggcctcaatatgtcgtggtcgtccagcaactttgggagtcgactgaatcgctgaacgtccggccaacaagcagctagcggccccaataaaagtcatcgcattcactattccagctaacgcataatcatgccactgggcgataatcaagacccctagtgtttgacccagtggctcaacaagtgtacttacgctcgcattaagccccatcacttgttggcgatcgtcaggcccaatccggtcttgaataacaattgtcaaaatactgccaccatatcgtcctagtagatccgaaataaaattaatcgcaacgaccacgtagaaaacaaccaccgtttgctgagtaatcacttgggccaagacgagatataaccccgcttgaacgaccttagtaccaatcagccagttagtttttcggcgcgtctgatcagcgagtcgccccgttaatcccccgaaaacgtacggcacaactgtcaccaccgaaacgatggcaacaaaccaatgtggatttggaaaattctttgcgtacatgagtaaaatgatattgaacaaactcacccccagcgtcgtaaaaaaatttgcactagcaatcgtttggagggtccgattttttaataaagtcagcattaatccatctcccattaagataatggacttagcttactcgtcattaccgtggtacaatcagcaagtaggttgcatatatgccacattaaggagtgctagatgacaaacatcggagaaactattcatcagattcgattaagtaagggcttaactcaacaagaagtgtatagcggtattatctcgcgctcattcgcctcacgctttgagagtggtgccaacgatattggcgccagtaaactctttgcaattctggataacttagcaatttcagccgacgagttacgattcatacaccaaaactaccagccatcagcatatgaccaggccctttggacaattcgtcacgcttatgaaacgctaaattttcccgccctagccacttggattcgcgaacatcgacacagcccccacgcctacgaacaactcatcgccagttatgccagcatcttgatgctatcctatgaccatcgttcaatcggcataacaaccacgacccagcccgcttttgatcacctgcgccaagccaagacttggaccctgcaggaactaaaattagtgcccgttctaattccaattattacatccatcgacggcttggccgcgctaacaccactgacaacccgtatggccgccaattgtgccagttatcaaacggcttggggcgatccctttcacgtcagcaacgacttactcgatttttatggatcactatttcaaactaaattgaactttcatgattttcaatccgctcaaaatctgaaaaccaagttcactgccatcgacagtcaccagttaaactgggatgggcggttgagccaacaattctggcttggcatctggaatctctacttcggcgactggcaaattggcaaccaattgcttgatgaagtcagcgtcttagaaacacatcatcacccccggattgataatacgttatttgcaattcgtaacgttcgcactaagcaagcccagacttatcgccaatcgcatcagtctcacaagcatctttaacaccgaaagcctgttctagcctggcaataaattatgccagactggaacaggctttttcttaatcacacatactgattaactggcctaaggcttactgaataatacagtctcacttgcgccagtcccaaagaccaacaatctgcaaggcccactgagaaactgccatttgatatagccctgtctggttcttcagggttactcaaccttgaagatgctcgttcagttagcgctaagttacttagtttacaaatcgtaagagttgagccgtaagtgtacacacagaccccatcaaaaactggtgacacctgggcacatgtatgatttttagtatgtattgatactggtgagcagacgtcttcattaaaattagatttgaaaataattagtttttggcgtatcgtctatgtcaaccaaataattaaggaggcgttttaatgaaaaacgtgacacgaattttaacgcttagtaatgggtatcatctttggagccacactagtaacttaggcggccgcacaaaattgctctgtcttcacggtggccctggagatactcatgaagtttttgaacgttttggtcctgaattagccgatctcgacattgaggtgacgatgtatgaccaactcggttcgtggtactccgacacccctaactgggacgacgatgctatccgacaacagtatctcaccgaagattattacctgagcgaggttgatgaggttcgccaacaattagggtataaacactgctatctcgcaggtcactcctggggtggcatgctcgcaatgacatacgcagcagatcatcaagaccaacttgacgggctaatcatcattagcatgatcgacaatattgccgattacttaaagcggatgcacgcaattcgcaccgcggagttttcaccagctgaaaatgcctttatgctcgcaattgaaaaacgtcaacaatggaataacccccactatcgccaattaataacacacctctaccaccaatatatcaatcgtcgtcaccccagtatgatgcaacatcaactcgatattcaagccaagcccgtttacaaccattttcaaggcgacaacgagtttgtcgtttatggggtacttgatgactgggacttctcggatacacttgcaacaatccaagtaccgacactgttaatgtttgctgatcacgaaaccatgccactagcaacggctgaacgaatgcaacagcgcatgccgaacgcaaagttagtcgtaacaccggacagtgggcataatcatatggtcgacaatccagccgtattctttacttatctacgaaactatttttctgatcaattgggccgctaacaaagcaccgttgtcagttgcgacaaacgacgcctcactaattgtcaacgccagcaaccacagtgccactttatgaaaacatctacgctcactcgtttaccatctcaatgccctgactttatgccatactgaggagaaattgcctatggatttaaaacacacccctagttcatctaatactaaccttgacgaatttggctatcaacaagaattaaaacgaacactatctgttaaagatttggttatttacggcctaatctttatggtgccaatcgcaccaatggggatttatggcgctgttatttcggtttcacaaggtatgattgcgttgacctatgccattgggatgctggcgatgttctttaccgctctcagctacggacaaatgtcacaggcctttcccgtggctggatcagtttatgcctatgcaaaacttggcatcaataaatcaattggttttctgtctggttggatgattattttagattatatctttgtccccgcattactctacatcatcgctgccaattcattaaaatccctcctaccaaccattccaacttggctatggctggttggttttattgcaatcaatacccttattaatgttggaggcattgccttcactgctattgcaaatcgaatttttctcattggtgaattaattgtacttgcttttttcattatcctcgggagctatggcttaatgcggggaattggaaatggtttcacactaaaaccattttatgacgcaagtcactttaatcttaattttgtcatgacagccacttcagtagcagttctcagctttttaggtttcgacggcattagtaccctagcggaagaaaccactggtggtaatcaggctgtgggaaaaggtatcctatggtcgctattaattgtaggcgcattattcatcattcagacttacttagctgctctaatcgttcctaaccggcattcttttaacgatctaaatactgcattttacgtcgtcgccggcaaggtcggtggcccattcctaactgatttaaccactattgccaccattctctcttggggatttgccaatgcattagctgcccaagctgcaatttcacgaatcctattcggaatggcccgtgaccacaatttgccacacgttcttgcccgtgtacatccccgattcaagaccccatatatgagtactttactagtagctattatttcactgcttgtcgggttaacttttatgaatgacagtgggacactctctgaaatcgtcaattgtggtgccctgaccgcttttctagtgattcatattgccgttattaaccacttctttatcaagcaacattcccatgactattggcatcatctcattgtaccaattatcggttttatcattattggcttcgttatgattaatttaaacgtattagcaaaagaaattggcggaatttggttacttattggtattggctactatctcatcttgcgtgtattacagcggaatacggaaatgaatttataactcatgatggtctgagcttgagcaacgtaaaaagaacttctccaaattagaagaagttctttttgcatgatataaaacaacccctggcttaaaccgactttgtctggttcaaatgcggtagagctaagaaaatcactaatccaacaacaaataaaatacttaaagaagcagcaccaaccgttgacttccccgtcatttgggtcacgattccaactaggacggggcccatcacggctgagaacttaccgagaatattgtaaaagccgaaaaactcactcccactagtcttaggaatcaaacgaccgaagtacgaacgactgagcgcttgaatcccaccctgactggttccaactagtatggctaaaatccaaaaatccgtcgtactattcaaccgcaacgcgtacaagcagatacctaaataaataataatgccaagcaagatgcccgtccgggtcgacgttttattcgctaaccacccgtaaagcagtgaaaacggaaacgcgactaactgaacaaccagcaagacgatcatcaacgtggtcgtcgtaattcccatatccatcccaatcgaagttgccattgtaaagatcgtgtcgactccatcaatgtagaagaagtacgccaccaaaaaccacgccgcagcgcgataattccggatgtgtttcaaagtcgaccatacccgttgaaaacttgaacgcaccggatgtgcactgggtgctaacgcgtacttttggtgaacgtttttcaacaaaggaatgtaaaagataatccaccacgcagcggctaagacaaaactccaccgcgcgaccccatagcttgataattgaccaaaaccactggttaattgtaagaccaagaataagataaacgccaagacaccaccgagatagccaaacccataaccatatgacgataatcgatccatctgatcgtttggcgccacgtcagtcagaaaactgtcataaaacagattaccaccggaataaccgataattgataaaatataaatacctaatagccacttccaggcactagtcggggcaacactcagccctagcgtcatcaccattccaagtatcgaaaagatgttgagcattcgtttcttggcatggggatagtctgctagtgcacctaggacgggcgccaaaatcgaaactagtaaggtcccaatactattggcataaccccagtaagccgttgcattagccggtgtcacaccgctactttgggcaactgccttaaagtaaacgggtagcaccgccgttgtgacaataatgccatagcccgagttggcccaatcgtaaaagatccaaccccactgctgtttattaaatttcattaagttacttcgcgggaacctctgatcgcaatcggaggcggaacgagcactaaccacaatattagtggtgctgatgtccgcccgcttttcctctctcttttttgtctagtctttaaaaacaccatcgaggcaatgtcccggcatggggccatcgaaattcaatccgagtaaccgcgcaaatgtcggcgcttcatcgactaagttagccgtttcaatcgtcccaccagctttaactgctggtccattgaataacagggtcgtttgatagtcaggcttagtcgggtcatatccatgaaccccgtggtaacggtctggttggccgagtgtcgctggatggacgggttcaaccacagttggtcgtcgactttcatcagtaaaataatagccttcctgggcttcaaccatcaatgcacaagcagggtcggcaccacgacgtgcagctacctccccagtaatgatggtctcaacaccttccacctgactaactagggtcttcaattcatctaactggtcaaattccggtcgcgtataaatgtacgttgagccgtacgccgtcttcgccatcacggaccagtcatcttcaaacgtctgatcttgacgtgcggtcaaccagccctgctgagcgaataacgtatttaaatgaatcatgtgatccacattgatttgatagtgatcacctaaaataacaaagttggtatccgcaaacgtgcccgcagctttagtcgcgtcaatcaactgacccacgtgccggtctagccggtgtaaagctgccatagcctcattggatcgcacgccatagcgatggcgcatactatccatgtcgactaagtgaatcatcgttaggttcggcttcttattcgttaacgtatcgactgcacaagccgtgatgaattcatctagttggggctgcttaatcccattacgaagatgcccatacttatgattcatcgcgagtaagaagagcggtgaactcgccttcaacgagacgagaacttggttcgtccaaatgcggttaggaaagatctcggcaaggttatatgtaatcttgctgccagccgtcactggccataaaaaagccgccgttgttagcttcttttgccgtgccaaatcatatagtgttggtacttgaacgtccttttgataccaataccaatctggtgaacggcgtgtcggttgtaacttagtattattaacgattccatgcacgctgggatactgtcccgtaataatcgtggtatgtgacggatatgtcagtgttggataaatgcccgtcaccgacttgacccaagtaccaccggtcatcaatccactcagaacgggtaattctgcttgatgttcgcgtaaatcacgaaatcctaacgcatctaaggaaataatgaccaagtgttgatttgttgccatctcaatcgctccttcttacttaataagcttattcgtattattataccgcagaaaattaattggtgtcaggatcgttgacaaaaaacgggcgatcagtgaagcacgactgatcgcccagatctcttttcaataattaccagctagcaatccctgttcttgtaaccaccgcaatgctaattgtggccacattgcagcctggtcattcaaatacttgtccttgccaggtttttgcgtcacatgattggctaacgctaacccatgaatcccactactaaataaatgatacgcagttgcgacctgatgttgtagcatggcctgcacatattttaacgaattgattggcgggaccaactcatccgtcgccgtttgccaaacaaaagcgggtttactagctgatgtaactaggcgctgggctgcccacaaccgggcatccgtggtaatctgattacgcaccgccgaagtcgtgggaaaccccgctgtcaaatcaatgactggatagcttaaaataatggcagcatgctgaccttgataatgatccaaatgataccgtgtgcgcaattctggttgggtcgcaacgccattataagtcgcaaccacgtggccgccagccgaaaaaccggcaagaataatccgctgacaatcaacatggtgcgcggacgcctgggtcgtaatccaatcaattgttgcacctaattgctgcaacgcccaaggatagacggactgatctcccacaattaattggtaattcaagaccaccgtatgcattccggcggccatcatccgggttgcaattggcgcttcttcccgcccagaatgataagtaaagccacctcccgggcagataatcatgattggataatcaacagctgtttcaaaatcactaatttggtctaaccaatacgccgtgatctgaaatgggtgtgccgcagtatttaatgtgcgctgttcaacttgcatatgttccccctcctactcccgtattaccgacttgatttcgctttcattatagaaggtcacatgattgcttgtcaatttttattcgaataaatatcgatatttattcgcttatttactcgctaatgactattatttgctataattaaattaattatatgatgagcgggggtattaaaatggggaaacaaacattcagcgacatctatcacgttttaaaggaccgcattctcacgagacactacagcgttaagatgcgattacccattgaagacgaattaattacagaatttgatagcagtcgctatgctgttcgtaaggcaatcgcacaactagccaaagacggcctagtttacagcgttaaggggcgcggggtggtcttattggagcatacgccacaaacccagcaattcaatctggctttaaataatctcaacggtctgcagagcctcaacgcggagcgccacctcgattatcagaccgaggtcgtggcctttcagcaacgaatcgttgaccagccgcttagcacacataccgcttttgaagtgggtattccagtgtatgctattcaacgggttcggatcgtagacggtattcgggcagtgctggacattaactattttaacgcccagcgcactcccactctgactaagaccatcgcccaacactcaatttatcaacacttcaaaaaaaatggtctgaaaattgctgtcgttaaaagaatgctacgagtcgaatccgccaccgaactcgacaaagctcagctagcgctcggtgataataattgcgtcggtaatatgattagcatcgcatttaacgatgaaggacgccaggttgaacacactgaatcccactttattccgaacgaatttaacttcaatgaattaattcgtaattaaaccttaccaacattacttagctgaatggtcatccggaccatccagctttttattatggttacttactttagaccaattcagtcggtcaattaaattcatccgtgaataagtttcaacataaattaaaaatatattcgaataaaagttgactaatgtgctgaattatttataataaatatcataaatgctaatgggggttagcatttataccacgtttcactagtggcgcatttggggtcaagagattaggtcggtcatggagtagagagaattgagcgtcactagaccaatttggtttagtgacttttttatgcaaaaaaactgttgattcgcaagattaaacttgccgaatcaacagttgcttcaaaatacaattttaagcttaataccgacgcttccgccggctaaccgctgcagcacctaatactaatgtacttgctaatgcgattcccgctaaactaatcatctgacttggcgcttcatcagtctgtggtaatgcttgccccttagccactgccaatgcgctagccaccttagttcgtagagcttgtaattgcgctactaacgccgtattatgatgcgctttagcttgtgcgattgcccggtcaatcaagttgatcagtgtttcctcatccttaatctgatcgccaaccactgcttctttttgaacttcctcaaacgccgtttccaattcagtcgcagtttcgtccgtgacccagtcagctgtaatttcattgtcgacttcttcttcgatttgatcgacaacttcgtctggcgtcacaccagcttcgatttcatcttcaatatcgtcttcaaattcttcttctgcgtcttcagcttcttctgcgtcctcaatctcgtcaaagtcaggcatttcaacatcgatgcttggatgaactggtttgtcgtactctggttcttcttcttcgccattatctggcatttcgatatcaatacttgggtgtaccggtttgtcgtattctggctcttcgccctcgccgtcatctggcatttcaatgtcgatacttggatgtaccggtttgtcgtattctggctcttcgccctcgccaccatctggtaattcggcatcaatacttggatgtaccggtttctcatagtccggaactggttctggatcattttcattatcaacattatcctgtaaatcccaacgatgggtctccgccttcacgttgactttattagcaatgatgttgccatcaatattttgatttgcatcaatttccgccgctggggctaaaatactgccttgaaatggccggtcgacactaatgacaccagttactaacttgtcactcgcggttgaatcatagaagttccaaagcaaatggttatcaccaaagtcttcagtttctttattattccgctccgtaccgtcatcataaatgattttgatctgcgagttaacttgatagttggtcgcacctgccgtatcaacattaataatgaccgtattaccatccgcatctgccgatagtcccttgattgtcagcggcgtactcgtgtttaaaacatccgctgacagattgatcacaatgtgtccatccgcatcaggttgcatatccgtcacatcgatgacccgctgattcatatcttcaaaactgtcactcgtataggtggcgttcgcggacgcttcgctaagactagcgctcaatttttccaacttagcaaactctttgtcaaaatcaatatagacgttaccatctttgtcttgataaacttcagaggcaagtaaatggtcgatatagaccccgttgaccatcggccgattaggattcgaaacatcaatctcaatattttcgccaaagataactttattgctccgcgtctcaccagccgaaacaaacgaactcccagcaatattactgatattttgaatatacgaaatatctttatctaataattcttcaataatgttcgtcccaaagttaacgttgcccactaagttttgcaccgcaacgttcccattcgtatgggcatgtagttccgcttcccgtgcaaaaatatggaattgggacgaaaccccgagcatgttatgtagatccggataatcgtccgtcacattaccaccatcggcaacggcatcgtttgcatgggtcacagcttgactaagcgccaccgcgacggtctggggcgttgcagttgtcgtcgactggtctttagttgtcgtcgtttgctgggctacactatcactagtcgtcgtaccggcaatcttagcactagcatcggtagttttagcagccgttgccgcggtatcattgctggtagctgagtcagtagtcgcacctttattagaactggttgttgtccgcgcagccgttgcagtggcagaatcagttgtggtcgacgtctcttttgtcgactctgaaccggttgtcgcattcgtctcttttgccgtctttgaaccagctgtcgtatctgaaccagtttcagtattggcactagttgtctcatccaaattggtggtagcgtttgtatcagtatccgttgccgccttagttccagccactgtgccagcagcagtctttgaattcgaaccatcggtatctaaaaccggctgattttggttagttacatccgcttcagttgtggccgcagtcttcaaagtttgtgtcttagccgtgactgatttggttgtgcttgaactggttgatgccgtatcagtccccgttgcagtcgttccatcatcagcccgagccaccagcgttgttgtgcccatcgtcaagataacggcacatgcaaacgcccagcgacggccaattttgtacattttaaaattcgtccgttttcgctccatcatttacccacctaaaatatagtttattaactttcctttaattcaattctattttcacgctttttcatacaacattcaactctttatataatttattttgtattgttatataaacagtggatgaatgtcaatagacgtgccagcaaccattacaggtcttaactaatcataagttagtatttttgttatctattcgtttacttggaatatcgattatcatcacgcgcttattttacacaatgtctcaaacccacaaacagccgcctaaaattagtcaatacttgcctcgcagtacgaaaaattttggtgtgaaagctcgtttaagcaatcacaacagccgcctatccacacaaaaaaagactggtcacaatcaaccagtcttcaataatttaattagtcacgtattgaccaacgacggtcagtcccgttaacactttacgtccatgtggtgatttggtgtcgatgactgcagttaattcttgccccgcaagattaccatgatgcttaccgccagcccatgctgcaacccccgttacatcataaacgacaccatcaaccgccacgtatgcgggttgaccatcctgaccattatattttgctaattcagtttgattaaatgtcgctgaattcatgccgaatcactccttcacaatttaccgtcatgataaactggactgccaagtaaaagcaagtgatccgttcttaaaccaaataattgacctatcttgaacataacacgacatcaaacgatcgccgaagtagttatacccccacaaccatctcggtaataccggcctaacctttgaccgacgaaacttaattaactaggtaaccatacttacgttagcacccaattaatcgtacccgtgatagcagttgtgcttataagtctgccaaaacttaatcgctgaccaattactgctacccacaactacttaatcttaataccttataacatcagcgacgccgtacctcctagtacggcgaccttgtgaaccagtactgttcatgcgtccagcactgcccctaactgcgttattaaaacgcacacctcagccactactgcccattcaatgggctgcgtcgaagcgtgacgtctagacacaccccgtatctaggacgtcgattgcttattgtcaaccaattaattaccttggggtggcccgatcgttgcgacccgatgattaccagccatactggtcgtaatacctgagataacagttcccatcggatcgacttgattacttgctgccagcaaccgttctcgaacacgaacaaccgcatgtctaatcgtcaataccaccgtcgttttaactggttggagccgttgtgtcagtagtgaaatcacttcaaccaacatctgcccagcaaccacccagtcacccggtttaacgttgaacttaaatgtaggcgattccaaagcactggttaattgaccaatccgtagccagcccaccagaccgttggccgctcgaaagccaattaaccgttgattggctgccacggctgtgataaccccagcaatgggcgcaacaatttgatccgttgccggtataatttgctgcttaaatcctagtaacccatataagtgaaccgtatttgcaagggtcgtcacattgatcacttggcgtttaaccggcgcaactacgggaattaatgagctaatgaccactggcacacttctcacttccttactttataaattggcaaccattcgtatttaaataaccttagaacgtgtttagaatcttttcaagagtattcgcaggaaggctaagctaatcatcatcttactggtgttcagctttcgctcacaattgcgccagaggcgccgatattttcctagccagctaaaactgcgttcgataacccagcgttgcggggtcacttgaccgtgcctaaggtcactctgtttagcaataatgacttcagcgttaatcattgcctgaactgattgagcaaagttgttaccagtataaccaccatcggccattactcgttgaaccaggtcaaactgtgatttgtttaacgccagtagcgcattggcgccatcacgctcagaaacattggcggttgtcacatggactgccatcggcagcccattgatatctacagcaagatggcgctttagtccaataatagacggtttcccatttaggaaaatcactgggtaaatcgcgccaaacgcacccatttttcaaggtataaagcagggcacaaaagatatcatataaatcaacctttcttggcttagtccgcttacgtatgccttctagatctgtccggattagttcaaattgttcacgagagatgtcgctactataatggtgtgcaaagcttttcatggattaaaaactcctgtttttgatctaatttaactaaaatcaaatcgaatgtcaaagtatccaaacacgttcttaacaaacgtaacgtaaaaaacttgttttctttaatatgtaagtcaattagtttaagtcattgactgttatctttacaacataaaccataccataattaaactagaatgccagcataattaacggtttcgattaaggtttacatctgttagcgttaattcgtaaactcaattaacgaacgatgctactaaatagctgaaattggccaccataaccccaatgtcgcactcaagcaatcttgtagatttgacatcatgtttccccaatacgtcaatcaggcaatgacggttaggcctacaatttcagtcagaccgattgcgagcaaaaaagagcttccggcttttattccgggagctcaacaagtcaacgttatttatttttaatctcagccactattcaaccgtaacacgcatccgcccgtgccgctttgaaaaatagaggttctgatcaacacggttgtacaaatcaatcggactaccatcggcttgatgcagtgtcgagacaccaaccgaaatcgacacattgatttcctcgtcttcatacttaacaacgagatgattgactgcttcaaagacctgacggacaatcactttggtactagccagatcataaccgggaaacaggacattgaattcttcaccaccggtgcgatacagcttgaccttctcgtcattggcggccaagaccgttgtgaccgtggcggcaacttcttgcaaaacgcggtccccctgcaaggtgcccgtacgtgtcattaacgtgcttaaagtgatcaatatcgaacatcatcatcgataagttgagattgttcttggcactatcatcgaataaatatttgatatgttccgtgtaagcggcaaagttctcagtctcagtcaaagcgtcgtgactcgcaaactgggccaaccgtaatttaatctcactatcttgggtcagcatattaacgtaggcgtacaataatcctgcaaaaatcattaagtagccatattcttgtaaagtattgtcccaatccagcgaatatttaagcttgatcaggccccacaagattccgccgtaaaaagcgaccgcgccatagtaatatagccaaggataccgatgcttaggtacccacagccgtagataattcatgctccagaaaaatagcacgaacacgacggcgtaactccacgattcccagtaaaaaatcgactggtcgaaaaccatgtacactatgaccacaggtaacaatgaataatacggcattcgaatatgacgaattgtcaaatcaagtgtaactttttaccgaagaaaacttcagacggtgtcttccagactaagaccttacggggtcgattatttaaatccctgacaaacttcgcgatatcttgatcggtcagttcatcaaggtcagttcctttgggaaaatactctcggatgagaccattggtattttcgttggtcccacgttgttgtggtgcgtgcgggtctggaaaatagactgagatatcaagctctttaccgacttcacgataacccgcaaactctgtacctcggtctggtgtaagcgtacgaacgcgtttaggtgtgactgtatgcaggaggtcgatcatcgcttgggtcacattcttggcattcactttgggtacacgctcagacagaaggtatcgtgacttacggtcgaccagtgacactaaacccgaacgcccgatcttgccgcgaacggtatcgccttcccaatggccaaaacgagtccgattctcacatgagactggtcgttcatggactgatgggacattattaaaacggccacgtcgttcgttgacagttcctttaaccttacgagttttcccacgatgtcgtaactttcgagcgaatcctcgagccccatgacttttacgtttaacgcctaaattatttcgttcaattccgcgataaatcgtgttgtagctgatatgccaattactgttctctaaagataaacgaccggcgatttgctcgggtgaccattgccgttgaagaatgcagtgaaggacaaagtcgcgtagctttaaattctccagtaccctgaggcgacgactctttaatcggcgctgttgatagttctgctgggcttttacggcagaataggcaccccgaccgccgttgcgtttaatttctcgtgacacagtggctttggaacaaccgatttgatcggcaataacctggtaagtatggtgtaaagttacacctaacagtatgcattcgcggtcttttaaggtaagatgtgtatatggactcatagcctaagaactcctttagatgattgttatggtgacttcattctacaggactcaggctaggagtctatttttattttcttacttgttgcacttcaattgtaaattcgtcattcaaaaaaaacgagcagaacacgacggcaatcaagtgaaagttaacaaactcccaactatctgctttaccgacgaccgacagttgcatgacaaacacaaagaccaacatgtaaatcacaccgtgccaagcattgacggtatcatcgtcaatgttaatgtgacgggcatgaaaccacgtcgtaatccaattaaagaggacccagtaaagtgttagaacacctaatataaagaaaatactcgttacgaacggcgaaattcgccaattagaccatgtcatcgtaaggatcctttctcagcatccgccgttgaccaattgccgaccatcatcgactaaccgcggtttcccataatagtaaccctggtgccattcaataccttgttgttcggccatcttttgatcaccctggtcttcgacaccttccagaataaattccagatggtaagactgagcaatatcacgccaaaatgctaattcatgaggaatgcgctccgcttgaccactcatccgtaagttttgcatcgcaaacttgatttgatcaacaaacggtagtgcgtggcgaatattctcaaacgtgttcgagcccgtccccacgtcatcaatgcttaatttaatatcatgttggtggaaaaagagactatatttttgaatctcgtttaatgaaggacattctgtcaactcaatcgtcagcgcggccggattcaacctttttttaggtaaatgatcgtccctaacatcaggtcgtcctcagcttgttgccggtttaaattaagggctaacacctgattagtcgctttcgtctgcaattgactagcaagttgttctaataattcagcttgtttatctaatgataattcagtgaacgacttcggaacggcccagtgaccattcatctctttacgtaacagtaattcataaccaaaaacagctcgatggctgtgatcaacttggggttgaacaaaaaaacgatacattcatgaagcctcgcttttaatgatttctttatgtcaatataaattgacaactcctgtaaagtataaccgcttttaactaaaatatcgagacatagttacagactttaattaaaaaaattattaagggttatatgtaaccgttatattgaccgtaacaaaaaaagaacgtcgtgacgacctcatcataacgctctttttaccagtcttaatttcacttaaccaacttatcccagatgacgactttaccagctgttagcgacttaggaacgtcgataatacgttgattggaactcccccgaaattgtagcgagagatccatcttatcttgtaaaaagcgcccatctaccaagatatcaattaatgatagcatcttcagtttatcctcagagtcttgttgcaattcttcccaagtataacctgaccacgaccaaatatccttcgtatttccaaattcggagcgaatgcgttcacaaatccgaatgccgacttgagtatttagaaacggttcaccacctagcaacgtcaacccttgcacataatcttgcccaaggtcttcaataatctgatcttccaattcttgtgaatacggttgtccataatgaaaattttgtgccgccacattataacagcctggacagtggaatgggcagccgctcaagtacaagctacagcggaccccttccccatcaacaaagttaaatgccttataatcagcaacatattgttcacttaagtcctctgccagccattctttgggcatcggattgtttggtcctttcgtagcgcgcggcattcttaatcatctccggaaacatatttttagcacgggacgcgatttcaacgtggcgaccatgtaccattggtcgttgttgtgggttacctagatacccacacgtccgcttaacaacatcacagtatttagggtcgtgattgccacattctggacagacgaacccacgggcagtggccttgaactcacccttaaacccacacttaaaacactggtcgatcgacgtattcgttcccaaatagccgacatgatcataggcccagtcccagacggcctccaaggctttaggattctgagtcaaattaggatattcacaataatgaataaagccgcctgacgcatattgtggaaaacgttcctccaaagttaatttatcgaagggtgtcgggtgcttacggacatcataatgaaaactattcgtgtaatattccttatccgtaatatctgcgatccggccaaacttcgcaatatcgtcacgacagaacgtatccgtcaacgattcagccggcgttgaatacagactataatgatagccactttcagccgcccactgcgcacacttatcccgtaacgctttcaccacggtctccgcaaaagctaacgcgtgctcgtcttgttcccagttcggaccaaagaaggtcgtgcagacttcataaattccaatgtatcccagtgaaatagtcgcccgctgatttttgaagagctcatcgacattaccacctgctggtagccgcttaccaaacgccccatacatgtataagagtggtgcattttccggcttagcttccttcgttcgttcgatacggtacgcgagtgcttcatgacaagtcgccatccgttcctcgaagatttcccagaacaactgttggtctccatgtgcggctaacgcgattcgtggcaggttgactgtcaccacgcccaaattcatccggcccgagtttacctcgacaccattttcatcacgccaaccttgtaagaaggaccggcaccccatcggcgtcttaaaactccccgttaatgccttgatcttgtcatacattaaaaggtcgggatacatccgcttggtcgaacactcaatcgcgagcattttaatatcataattgggatcattcggacttaaatttaacccccgcttcatcgtgaagatcaatttaggaaaaatcgcagttcggtgctccttaccgagtcccttgattcgaatctggagaatcgccttttgaatttctcgttcaatccaactagttcctagaccaaaattgaccgtggtaaacggcgtctggccctgtgacgaatataacgtattgatttcatactcaagggcttgcatcgcgtcatagatatcttttttagttttggctttcgcataagcttcccgctgatcagcagggacccactttttcgcatcagtcatatgtttttgatagttgattgccgcatagggagccaataattggtcgacccggttagcggaacagccaccatactgtaatgaagccacgttggcaatgatctgcgccatttgcgctgtggccgtttgaatcgaccggggtgaggcaacttcggcgttcccaatcttatacccatttttgaacatgccgtcaaaatcaatcaagcaacagttcgtttcaggcgtgactggtgaataatcgagatcatgccaatggatatcgccacgcagatgcgccttagccacgacatctggtagcatcttcaagcccatggcgcgacttgcagcaccggcttctaagtcgcgttgcgtgttaaaaatcgtactatccttatttgcattttcatgcacaacgctggcatcgcgctcaaacaacttttcaatccgtccttgaacattagttgctgccgcaaaccgctgctgttcagcttcaaagtaatcctgatatgccttagctgccgcggtcaggccttgcgcattcaaaatctgcatcatggtactacgtagctcccgagtatcaatgttgtcagcatcttgatactgggcaacaagggcctgcttgacgacccgtacctcgtcatcagtcgctaacaaccgtcgtaagacaaagtcaattttatacggatgaaatttcgtttgtgcgccaccccgctttgtgacggtcagtggccgtaattggtctaatatatcgttagttgtcgttgttagcatcttaattccccacttttcaaagtcattgattgaatacaattgatagtgcgttctgtttgaatcaatactatatatagtagctcatttccattaacttgcccattgccaaaattaactgtcaccttcagttgtgtacaccaaatcgctttaatcgtccggttagtgcgtctttggaatatttaaaaaatattttttatactgttttttatctaatatcagaatatttaatcaatctcgttaactaccgaaccaaccttgatacggcttgctttcaatatttttcacacgccataaaccgaattttaattcgttaaaaattaagctgaacacaaccaagttgttgtaaactgattaacttatgactattttgtttaactcatgcggcggattcgctataatgaaattaagtcctcattgagggatgtggacattggaggagagaataattatgcaaaaaagcaggggaataatcgttggcttgttgttgacagggctactgacaggatgccattctgccactgacacacaaacgcccaccgttcaaccagcaacatcaaaagtcagcgccgttcgctcagtcacgactcgggatttcttaggtcgctgggtcagcgctagaccagcaatgagtctgtacctcagtaccaatcatcaagttgcttggttccgacgcggacatacgcccattcgtagtcgcgcaacgttaacgttaagtgatacacgtgccacgttcacaatcgatcacaatgttgcaaaactgaccctcaacgacgctaatcaaatgaccatgaattatcaagggactaatatcgcactgattaaagatccaaattggcagcctgaacacaaccaggttcccaccacaactaatgacgccttaaaggcgggcaccttaacgccaacatttaaattgtcgtactaattgaaggccacaccacatttgcacgttgacttgtgtgagtgtggtgtgttttttagggcctgacaactagcgaacggcttgcttctgtcaaccgtgctctctataattaaattaatatgactaatcaatggaggaacatcaaatgattcgaccaattgtgcatgatcccgccgcgcttagtgtccctgctgacttagcaacccctgcagacactcaagtcttgactgatttactggataccctcgccgcacacaccgataattgcgttggaatggccgcgaatatgattggggtcaacaaacaaattattgtcgtgcaactcggtccctttgcaattgcaatgatcaatccgaagatcattgatcatcacggcacttacgagactaaggaaggctgcctgtccttacctggtgaacgtccgactagccgctatcaccaaatcacggtgaaatataaagatcaacactttaaaccgcaacaacaacgattcaacgacttcacagcacaaattattcaacacgaattagatcactgtgcagggaaactgatttaattgtgcctacttctaactgagcgggaataaatgttcagtttgctgaactcgttgatatttatgaaagataggactggttttatgacaactttagcttataatggcgagacagcaattcctgcactcgctcagcagcgtcgacaccaatctcatcacgcgctcggtaccgacattgatttgaccctttttggtagtgatagtgaccagtacctacaagctgcttgcgatcttatcgaccaatatgaagaccgcttgactgtcaaccggactgtttctgaggtcatggcaatcaaccaggcggcgggccaacaccccgttcaagtgagcgccgccacctatacactcgttcggcaagctgtcgaactcagtcgacaacattttggtttcaatgcgttgattggtccgctcgtgaaactctggcacattggttttactaacgcgcacgtccctgaacagtctgcaattaacgaacgattggccttgatcgaccccgaagccgtcatttgtaatgacgctgatttcagtgtgcttctcaaggtcacgggaatggagctggatctaggcgcaattgccaagggctacattgccgaccgcattcaagattactgggaagcatttggacagcgggccggaatgatcaacctaggtggtaatctgttaatggtggggacgtccccacttcatccggatgggcaatggcgcgttggtatccaagatcccaccactgaccgcggtaacgcgattgccagcgttacgattggcccctgctcggccgtgaccagcggtatttacgagcggcaccttgaatttaacggccagtcctaccaccacatcttagattcgcaaacgggttatccccgacaaaacgaccttgaaagtgtcaccgttttctcgaaagcttccattgatggtgaaatcgaaacgacgcggctcttctttgcgggccaaccgattcccgattgggcaactcagcgacccgatatttacggcgccatttttgtgactaaacagcgtgagcttcaaatcgttggcttatcacctgaacaagttaccttactcgatgaccggtttacaataatttagaccacaaaataagctaggtcctccaagaaattaacttcttgaaggacctagcttattttatggtccacttacaggctagcatttaatttgcagttgactttagatgcggtacgttcgacattaaaaccattttaatcaagcacagctaaatggcaaaaatatagccgttttagttaaaataacgcgacctaatccgctggtagcttagcctctaagcgatcaataatcgcacggacatcatccgttgtcttcgtctgcattaattcattgcgcaattcggccgcatgacgcataccgcgaacataaatcttaaagaagcgttgaagcggtgcgaaatgcccttgtagacctaagccaataaattgatcatacagatctacttgataccgtaacaattctagcatgtcacgcgttgaatgaggctggggaatcggttcaaaagcgtatgggttctgaaaaataccgcggccaatcatgataccatcgactcctggatgggctttggcaagcttcagaccagcctgataatccaggatatccccgttaatttgtaatagcgtcgctggtgccaaagtatcacgcatttgaactaaattatcaattaactcataatgcgctggtaccttgctcatctccatcttcgtgcgcacgtgaaccgttaacacgggaacctgctgttgcaacaaaaatggaatccaagtctcgtactcatgcacatcgtcaaagcccaaccgcgtcttaacactaacgggaagctctgcttgacgtgcgccctcaatcacttctttggcacgatcaaaatgtcggattaaatcactaccactatgatttttaatgaccgccatatctgggcagcccatattaagatcaatggcttgataaccttgattcttcacttcatgggccgctttcgtaaagtcctcaccactattgccccaaagttgaacgattggtcggggcgactcggcctcatcaacatatagtcgtccccgcgttgtaaacttagccttcgggtgagtaatgcttaacgcattcgtaaattcagtataaaagacatcgggggccgcagcgcgcatcacgacccggcgaaaaacggagccggtcacggcttccatcggtgctaaactaaaaaacggtcgctgggcggcctgagctttggccgcgatccgttgccaatatggcgactgcgtcatagttattcattcccttctagataataatcacttatccataatagcggtgttccacgttgaagcgcaagtattttggcggccgcactaacataattcgccaatcacaagccaaaataaaagtccggcgttaaccggactcgcaataatagctaagttgataagtttaattgtcgctttaacgaattaaaaccagtgcccacagcaatagtccaataacgagtaccaagtttaacaattccatccgcaaatcagcgaacttcagtgagctgaatgagataccggcagttgtatccatatatcggaagaaaatcccacttaaaactaaaccaactaacaatacaaatagaaccatcattcccgtcatcatcacaaactcaactccttatttagtaaaattcttgggctctttgaaaccatgtttatagtagtccagcagctactttcaagcaagtatttccggccgaaaaactggcgttcttagcatattattattaactaaacgataccaatcattcccagcaaaaaagttctttcaggaacaactaaaactccgaaagaacttttttaaatcgccattaattccgccgtcaacttagtcgctcagactaaagtaaccgattggactagtcttgcacttcgaaataatcattgagaaatcgaattgtgcccacacacttgttaattaatcagttgttttatggcgccgttgttgcttgctaaaaccaaataagctagttgcggccaataatacgaagcccaatacggtcaaaactcgattggtttgttcaccagtctgtggtaacgtggccgttttagttgcggtcgttggcaccgtctgctgagtcactggcttagccatggccggactcgtcgtcgtccgcaataccgttgtggcttgtcgtggctgcgtcgtaacaacccgctgcgctgttgggacggaagctgaacttgactgattaagagtgggcttgtccggggtcgcttgtggtgccgccgactgattagtgctggttgacgtgccagttgaatgactaacgactggtcgttcgcccacaggtttttcagtcattggcttttcggccgctgctgttaaggttgccaaggtccgggcgcgcacggtcgttaatccagcttgagcttgggacaattcccgctgtgcagtaacgacctgatcttgagtacccgcaacgcgctgcaacttagctgtcaccgctgctttcgcctgattaactgctgcttggggctgaacaatatcataatctctttgtgccatttggaagtcgcggctcgtgccactgacttcaattttggcgttggctaattcttcttctgccatcatcacgtgctcattagtcttatcaaggttagcttgtgccgctgttaacgtctcttgcaccgttttcagctttgcctgagtagtttgtaacgtgactttgttggccgcactgttatccttatcgaagttgctctgggctacttgaacagcagcttgtgacttagtcactgccgcttgcgccgtcgttaccgcagtttggcttgtctttttagttgccaattgttcatcaagtgctttcgttgccttgacgtgccggtcagtggctgcttgcttaagtacgcccatatgcgtctgaatcttttgattcttggctaacgttttgttggcagcgtctaacgtggtttgcgccgcttgcagatcactcatagccgttttgactgccgtagtagccatggttaatgcttgcaccgcttgcgttacctggtagtgggccgccttaacagctgggttattttcgacctgacttgctaaactgaccgtgccattcatccttactgcctgaccggttcgagtgttagattcggctgcatgtaccgtcattttctgggccatgatgccccctgttaacatggtgattcccatcactatcttaagcgcttttgacatactaaactaatccccttttaaaaagtattgcccagccatgaccagcatgatgatcaatatgaaactgctggaactatttcattttgccggattcaatttcaaaagcaaggaaagctagtgattcagcgtatttgtaatcaccaaccactcaacaactttcatccacatcaccaaaataattatatctagatgtcattactgcctccctcaacacgagtccccatccacaattaaacggtaacgaataatcatcaccgctaacaaatgttaacccgcaccatgatttcattagtgacccattctcaataaaaaaaataactaatatttcgattaccgtagcggcctcacaatattgatactaatttataccgttacttaattaggtgggccccgccatcggtgttagaatagaatttaacctaaagaaaagtgtgactgctatgaccattaatgacctccaagcattcgtgatggtgtacgatttacgccacatttctaacgctgccgtagaactccacttatcacaatcggaattgtccaaacgaatgcgagcccttgagaacgaactgaacattaaactactagatacacacaacaagcgccgtctacaaatcacgccagctggtgaaacgttctatcatcatgcgcataaaatgattacagactatgagaccatgatgcacgatttggcaccgaatcggccaacgacatttgccaagctcatcattggcgccattccaatctcaggtcaatataacattgccaaaaagatcgccacttttgatactcagcatcctgatactgaaatcaaaatcatcgaggatgagggcgaccaaatcgtcaaacggttactgagtggtgagctacaagcggccatcattcgcgatactcagacgacccaattgcaacccaccgaatttcaaaaacaaccactactcgctgacgaactcaaaattattttaccgcgtgatcaccccctagctacccagccagtcattcggattcaagccttagcgcggcagaaaattgcaacgttaccaccgggctccggtgtttacgaaccgatcaacgcactctttgctcagcaaggcatgacgccccaattcttctttgaaagtacgcatattgaaacgctcctgggcattctcaatcaaaataacgtgactttcttatttaaacaatcggtacttccgttcatgactgaacacgtggtcatgcgctcactcgccatcccgttcatcagtcaactgaactttgtatatccccagcgaacggggaaccagttactcaccgacttaattgactacttgacggtgactgcccaggaaaatcaacaagtttaaaaaatacccttttcatccgaccaaccggccgtttgaaaagggtattttttaaacttatccgcttatgccaacccaacgaggtggaaccagaacatctcaactaacgcaacgacaaagacaaccgccgtcagtgggattcctaaccgcatcacgtctttttgtgtgtaacccccaccagtatcggggtcgcttccaactaagacagcgaggttgtggaacggtaaaatataatgcaagtttgtcaccgagaagactagtaacgatacggccaagggtgaaattcccatatgagccgtggccgctacgaaggccggaatcgtaatccccatcaccgcaatgacagaacccatgaacatgtggataatcatggcaaaaacagtaatcacaatcgctaataaataaatattagttggcaagttgcttggaatcaaggtcttcgcaatccaattattcatgccagtcacaccaccgacattcccgattgcgattgccgaagtcaagaacacgagcacgttcacgggaacaccttcccatgatttggccgtcaatatcccgccaactaccgggagactcatcatcagcgcaacgatcaacgtcaaccaaccaacgtccaaaccggtgatcccactcgttaaccagagtgcaatcgcaatgatcagccaaataattgttcgaacttccttccccgtcataccacccaactgggcttgttgttgctttaacgcttccacatcgatgtggacttcctgactaggcttgaagaggaataagaacagaaacatggttaagatggccgcaatgatcatgggcacgcccatgtagataaagtaagagacaaagttgacgctttgaccagaggcctgtactgccaacggatttagtgacgtgtcaccagtataaaagaccccggatagtggacaggacgcagcaaagacagcgaggcctagcttagccaaatcgcgtttgggcatcttcgccgtttccgcgaccaccgtaatgacggacataatcatgaacgcccgaggccatggatggggaatcaggagtgcgaggataaaggtcagggcaaaaatcgaaatcacaatccctttccaactccgcacaaacttgataatgaatgcgtacgcgatgcgttgacccaaaccagattcattaaccgctcccgcaatcaagtacgccccaattacgagccacataattgaaccagtccacgccgacgagaagacctgtgacggtgtcgccacgttcataataatgagcaacattaagtaaatcccaccaacgaacgcgggttgcgcgatttgggtggcccaccagacgaccgtcatcaaactaagtgccaagtccatctgacccttagctgacaagccggcaatcggcaagaagtaaataatggcaaatacggcgattccgctgaaaaagccaatcgttttcttgttcacgagctacatgctcccttcaattttgacagcaaaaagccccccgaccagcacacttccgttggtctggcggctctttgtaagattaaattttggttcaatgcgataaaaatacgctcatcaagtgcaatggatgacgttacttcaaatacttctcccagtcagccactttcatgaattgggcccgttcaaattggtccttcatatcgaatggtacggtgccatcaatcactagtttagaactcatcccacggaaacgaatcgactttggatcatattgtgggcgttccgatgggtccaacggatgattccgcatgcctgataagaccatcaagtcctgatcggcttggaaacgggtattcatcgtccaaatcacatcattcatatcaaaaatatcaacatcttcatcaaccaggataacggtcttcaattccttaaaggctgagaacgcaagcaaagcagcttgccgttgaattccttcatccgcttcattatccttatgaatctgcatgatggtcatcaatttaccaccaccagccggcggattataaacattcgtcactttaccaggaatggcacggttaaccaattgtaagatactagcttcagttggaatccccgccatgctgacatgttcttcggatggtccaatcacgctttgcatgatggcattcttccgatgagtcaccgccgtcaccttaatcacttgcaaggctggattagcatcaccatcataacccgggaattcaggcatcgctttacccgtatgcgtattgatatcttcctgaatacgttcgttaggcataatgtacccctcaagcgtatattcagaacgcgcaatcgccttttcatcgacggtcaccccgtcaactaattgaacagcttggttccgaatcgcaccagcaacacctaattcgttatagccaaatggcgtggtcggtggttcgaaagttgcaccaatcgtaatggctggatccaaaccaatattaattgtaattggcattggcttgttagctttctcatactcttccgcaaacgcaccaatgtgccgaccgccaggcatgatataaatccctaacttatccttatcttcaaggaccattcggtgaatcgtcacatcactcttagacttgtccatgcttgagccaaacaccacaccgaccgtaatatatggtccagcatcttggggcgtattcgttggtgctgccactaacttccgaatatcaaagccttcatccgtcgctttataaacgacatcgtgagctggcgcatccgcttcagcaaccgtttctggcgccactggattagagactgcttcgttcaagtattgccctaacgtctgataatcgtggtggaacatcttaccaacgcgccggcgactcgccatcaatccagtcaagacccgcgtatcaggaaaccccttaacgttgttaaacatcattgctggaccctcttgcgttggccgttgaacggtcccaccagcaccgatataccgataaacaccagaaagttccgcatttggatcaacttcgacgtcagtttcatgatagttctttggatcatccttgatctcatcaagcacgcgacgcaaatcccatggttgttctgccatttcattcatctcccttaaagtttacaagaccatcatacggccactcgtaagcgggttcaattcggattgcgcagatatgttattcgtgaatggaataatacaactaaacgcattaggtcgatgattgttatgtattaattatgattgaaacgtgctgatttccaaagtcaaaagcagccagcttaggcccgctggaaaaagttcgagttagcgtaaaattgcttagttggcgcgtcttacgccgacttccaggcatttctgccaattgctggaacgcggtggacacaaatttaagccgcaacccacgtcttaaatactggtcttccacgctttaatgccatattggtgaaacgtgctcgggtcagactgagacttccggttagctacgctatgacgtcaagcggaaattcaccgcttaacgccctagctaggctaatcctcagtctcaccccgtctgaacctcacactcttggcagtgctgagcattggccgaaatgccttccagtcgggacagtgttcgaatggcggacatgtgcgtacccaacttttggtgaattcgtcattgtttttcataaacaataactttgtcaatcaactgtcagggtgaaaatgatattgagatagctcactaatcctgaattggtgtagtgagatttaagctcttgacagagggcttaatacacctaacgctttgtttaatcaaaatagccaacgacaaattgtaccgagttcggtggtcgttcattagccattcgagcgacttcccgaccggaggggctgggtggacaatgctcagtagccaaattattcttagtcggaagtggggtacttccggcttagaataagactcgtatttgagatgacgcgggttgggcgttagctcaaatcgacgtcggctacgttccagcaattgtcacccagccccggaggtcggaataggacgcgcaccggctgacgaataacaatctaaacttggcacgtttcaatcataattcatgactaacgaaccggcacagcatttagccgagtcgtatttttaatgcgtgacatgtcgtttattgtgcaaactggggcattactaaataaatacgccgtgtaaacattgataaacagtttaatcatgtttatactttaaaatatgttaataatttttagactttcttaagttattaacgatgattagtcatcaatagccttattcatcgattagcacttattattcatattcaagtgacacgtcttattcagaattttaactcgattgatagtagcggctatttactgtgaagactccagtaaatagttttttattgtcgactaatcaatctatttttggaggagcatcggggaatgtataaacagcaccaattttttaaagccgctgacgatcgtcgcggccaagcatcgttttgtcctaactgtgggcaagcggtggccgcaacggatgaattttgtcctaattgcggttttaagttgcacgcaaccactgatcagccatcgccatcagtaaacaccgcgcagtcaacaacaagttcgacgcgcaaggttcgacaacaaacccaacgccatatgccaacttggggttggggtctgattgccgttatcgttgtcattctgattggcggctatctgtatggacagaattattatcagccgctcaatcagctcgaccgtgacttaaccgcactcaagactggaaaaggtttagcgaagcaagtaactagcactgacccatcactcaagattacaaatgatagcgtcaagccgatggtcacttactttaaaaacaatcgaaaatcattagcatcactggctagttcgcttaaaagtcgttctgcgactaatgattacggtattcagttcgttaaaaccggtaaatcctggttgtttttcgataagtatcaactacaagtcacttctgtttatgccacactggcgacgaaccaccgtaacgttgcactcagcgttaatggtaagcacgtcgcaacatctaataaagcaacttacgagcataaaatcgggccgtatgttcctggttcatacaccttgactgccaagggaacggttagcggccatcagattaccaataagggcacctattacctccgggcaaacggccaaacttacgacttggatttacgtacaatttccttcaccgttaatggtacaccgaataccaccgtttatatcaatggcgaaaatgaaggaacgattaacagcagtggcacactggcgctgaatgatattccctggtctaatcgcatgatgttgactggtaaatacaaagccggttcacaaacattgaccgccaaacaaactaacgttagtgacgctgagggtcaagacgtggacctcaaatttgccggtgtgatgagtaaagatactgcctcggactacctgaacggtatcttcaccgctgtcagcagttatacgtccaccggtgacctatcggatgcttcggattacgatgaccgcactttggacgactacttcgtcaacggtaccgataacacggactacaaagaactggtccaaatggcgaagggctactacgacaatgatgacgtcctcgatgtcacctatgagccgactgtcttatcaacggttccagcagctaaacaacaaagccagatcacttatgacgtcaaatatgactttaccaactctgaagatgaacgcattcaggtctttcgttacaccgcgacggtcgagaaaaccggagggcactacaagattgttaaaatcacgccggcccaaaaaattcggtcgtacactaaatccgatgattctgatgattaatgaaggagaatttaacttatgaaaaaatgtcccaactgcggcactgagattgctgccaatgcaaagttctgtacccactgtggttacgatctaaccaaagcgacgccggcctcggcaacggccaacgccacttcagccacagctacccaaacaacgactgcaacgacgcaagcagctgtccataccagcacagcttcagccaatcaacaacaatcggccagcgctgaaaaacaaacagcatcacgttcagtagcagctgctgatacgacacggacggctactaaccaacaagtccaacagctgcaatcatctgctaagaattattttagttggctcttggctagctggaaaaatcctagctgtgaagtccgaactgaaagttattttagttacatttcctttgtcattgaagcactattcatgacgttggccgctgtaaccattagcaataagtttctgaccactgccaatgacagtcaaagctatttccacattagtaaattagctttttccaccgacttaaagattttcttatgtctcctaatcggcatgtgcttctacctggctgtcggctatgtcacttgcttacttggaagtcgtgggaccaaagtcggctttacgacctatatgaaacgcttcggtcagttaaccaattacgcaattattgtgaacctattattatggtttgcttcgtccctagttaacttcagtgttgataacttctttaccattgcggctagcttcagatggtcgattatcctgttgagtgtcagtgtccttgtctggcaattaggtttgatcttcgtcattaacaagtcggtgacccaaccattaattagccgcgtctacctagcccttattgcggttctagtcgttagcctgctgttctactttatggataaaattattctgcaggatttacagactgcacttctcagtcacgcaactgactttgccaatcaaattggtaacttgttcggtagtcaatactagttgttcgaaggtatcacaaataaagcctcgtaaattaacgcttatgataatgcgttaatttacgaggctttttatattcattagattgagcaaattaatttgtaaccgataacagggtgctactcgaatagtgtccgcttgagctgacggctaacaccgtaacccaccagaataatcgttattaaccatccggccgtcactagtgctttcccgattgcgatgattcggcgcatcgtcccacctccaaaatgagtcgctggttcagccattacgcactcaaccgatgactgaccgatagtaactcactaaccaataagttttcagttggcgtcaagcgcaactgtttagtaaaaatattataagtcacgtcattcgttaaccgcttaattagcgcatgatcaagctggggcgcctgtttcaattgttggtgtgccttcaatagtgctgcccgaatttcttgattcgccgcagttggtgctaattcttgatataaatcttgaatgattccctgtacttcacttttcacgttgcacaccttactttcagaaaactaactactcttagtataggcgtcttccggtaaaagattaaggttattttcattgaacattaaactaatttgtcagcaccgcctttaaactcaccaacgttaactaacctaacattatattaactggcgtaagtcatcatttaaacgcggccagtgctaattggatcgcggtagcgcgcacatcgccgctaaagcgatggtcaccgtcctgaacccaatgcaactgactgtgctgatagacctcatgatacttttcagaagcctgtggcgagaccaccgtgtcggccgtaccgtgaatcaatgtcaccgaaccggcatactgctgagctacctcataaatcggcaactgttgcgcggtccgcaaataaaagccaccaactttaaggccatcacgaatattcaaataggccggaatatgttgtggatcataggtcgcaccttgtagaacaccttgttgcgcatcggactttaacgttgcggccggcgccatcaagatcagtttgtcgaccacgtctggataatatcctgctaacatgctggctaccaccccgccttgcgaatgccctgccaagacaatgtggtcataatgtaaggtcaacgcttcatctaaaactgctttagcgtccgcaatctcattaatcactgtcatatcttgaaaccgaccttcactacggccatgaccattgaagtcaaaacgcagaactgccaagccgtgagcaactaatgcctgcgccaattgcggcacaaattgggtcgtatcatatcccatatcggccgtaaacccatgcattaagatgactagcgttgagctcggtgccgccggagtctccaaccttgcctgtaacgccaacccatcccgtttaatcttaaattccatcgatgtcatctcacttattcattattcacacctttaatatagtggatttacgtcccatttcatagtcctgagcactcaccctatcctgaacaaacagctaacactatacaaaaaacctgtttccatggccttcacatcagtcatagaaacaggctcttaatatcggctggacatcaaacgatttccaactgtagctgctgcgattcgacccactttgccgcaactagaatgcggtacagcacgattgaaataactgctggcatcagcaccccagtcaagagatagaccataaaactgttaaagttcgtcgatgctaacgaaatcggtgcaattaacgaattcaatcctaagccggccagcttgtaactggttgaaaaatgaaaggcaatcgtcgctaccggggcggcaataaccgcagcaaccattggtggaatcgctaaccgtggattcaccagcaagtttggaaattggcctttaggcgtgataatcccctgcgcgatattggcccccaagttgttttggcgaaaagacataatcgtaaagcccacgaactgggcggttgttccaattaaggccgcgcccgatgagacgggatctaacatgaccgccaccgccaatgcggccgaagacgcaggtgtcattaaaaataacgcccaggcaagtgaaacggccatcgaaccgatcaatgggttgaccttcatcgaagtcgcgatgaacttgctcagccagaccaatgcgggcgtcgttacggctgctaacccgagaccaaccaccgcaccgacaaaagtggccgctaacgggaccaacatcctatcaagcggcgtcttaccagttaaataattaccgatcagaaccgcgactaacccagccgcaacggccgaaatcggttgaccggtggtaaagatcgagctctgagctgcttgggccaacgtatgccccgtcgctgtgacgccgttagttgcggactgcgagaaaaagacggcgttcgccccgatcgtcgacgaaatcatggcgctaaacgtaactaaagtgttgctgttgagcatcgtggcaatcgcgactccaaatgccggtcccaataacacttgcgcaatcgcaccgacttggtataatgccgcccagtgaacaaaattcgcgagtgactgcaataacaatccaatccctaaacaaactaaaatagcattagaaatacctgccgaaactttataaacgtaatccatggtactcatcttatgtgtcgcggtagccgcggtcgtagttgcttccatatgtaggcctccatttaaattaataagaatatgattagataaaaatgagaatagctacatttaaccacgtgttttgaaaattgtcaacgtattttcatcacattatcgttgccaactaaacgaaaagaccagccaggcacgatgccctcgctggtcgctttcactcatcgtattcaaatcattggcacaagccatcaatccaggaaaataaatcgcctaaatcatagtcaccactgtggggaatatcccacggtagcgcaaaatcaatgccataaccatgattttctaacattattgctagaataatcgggattgcaaaactcgtatctcggtcggccgcaccgtggcgaatccgccagtgcttagcaacttgtgacgaagttgtcgttaagtaactgagcggattaatcgcctgaatcagctcagcgtccgctagttgtgcagtcaccgtacttcgcgtctgtgccaaggccgtaaagtgcttggctttcgccgttgcatcgccaaacaaattattctctggactcgtcaaatctaattggtcaaacgccgggacggctttcatgcgagttaacgacttcaaataagctgataaatccaagtccgtcacctgatttccagtaacgacaaagcctgcgtacttatgaatatccgtcccttgatcgaatgccgtctgagcagatgatatcaataattggcgaacaacatcacgaaatgaacccattcccgcctcattaagcgtcaagtgcgtcccgtcactggccgtgagtttcaactggttcaagtaagtactgaactgggcttttaacgccaacgaaagggcctgttcttcaactgtgagctgaccactaaccggttcaaattttggtcgcccattcttggtcgtccccgcaacaggctgataacggtgccagtcattaataccattaaactgccactcgtaggccatgtctgcgtgttccagattatgaatcgggcagtaagctgacaccgcaaagatatcgtcagtcgccggtgctgccccgagcgcagttaaggctggttcaaaataagccgaattgccactcgcacccgctaaagccgaagtggcacccccagcactcgttccattcgtgatgatccggttcgcgtcacctggcagccggccctgattatacttaacgtaacggattgccgccttcatatctacgataaaagccggcgcttgcccgacccgttgcccagacttatcaaccgtcgtacgaccgcgaattccagcggccaccacaacgtaaccgcgtttaagtgcctgttgaatcgtccctgcattcgtcggccaagtgacacgttgcggatcatccgccggtcctggcaaataaccgccgaccgtattcggcatcagaattggcgccgttgcccgctgataaccattgactgaactgccatgcaagtatgcggctggtacaaaaacgtttaggacctgaatcgctgcgactggatgctgaacgtactgaatattacgggcagcataatattgaatagcctgcccggcaacttggacctgttccggcaccagccagtcagcatcaaaaatcaatcggttactcatcttgtgacctccatttctatctattcgttactttacccccattatccagttaaaatcaaatcgaattgcgcaaccagttatgccaattgcgactaataacgattaacgtagtcagcagccgcttgtgaacccgtcgtaaactaatgttgccgtgcgttaaccagtgagcccttctaacgaccatggtcgccattgctaactaatctaactatttcaagttagctattaaatgaccgctaactaaaaacggctttctgaattaacagaaggccgttttaaaaaataacattatatgtgcatcattttagggctatcagttagccttaaaaccaatgacggataagtgcaccgccacctagcgttaatacacctaacaaaatgccgactgaacgaagcgcttgactgtccatcttagcttcgttagtttgtggcaatttagcaacttggttaggcgttgatggggtcaacgcgtcactttcagataccgttgtcttagcactagactttttagtatccgctgctggcgtttgatcagcaccatcttggcccgtcgttgtgttagcgggcgtactcgtaaagacactcgaagttgaatctttcaatggttttgacgaattagtactgttggaagtcgtactcccatcgtagttactatcgaacccaccatcaacatcgatggtcccagtatcttcatcgatatctggataaaccgccgtattatcttcgggatcttcaatgtcaccagtctgatggccattgtctggttccgtagtcgtattgtcagaactctcagaactagtatttacatcactcgagctttcagaaccggagtggtcggaactggagtccacagcgctcgaactttccgaactagagtggtcggaactggagtccacagcgctcgaactttccgaactagaatggtcggaactggaatccacagcgctcgaactttctgagctagaatcgtcggaactggagtccacagcgctcgagctttccgaactagaatggtcggaactggaatcgacgtcgctcgaattatttgagctagaatcgtcggaactggagtccacagcgcttgaactttctgagctagaatggtcggaactggaatcgacgtcgctcgaattatttgagctagaactgttcgaactcgagctggaacttaagtcgccagtaccgctcccaccgttaacgactttttcgtagaccttaccgttagcttcttcgctgttcttgccaccggacgtaccgccgccccattccattacagctttatttttaaaatgataattttgatcaattaattctgtatccgtaattttagtatagtaatcgatgacaactaggttgctgactgtatcgttgaatttcaagtcaaaaccattatcgctgtagttaacttgataagcatcgtcactaagcttatcacgccgcttgtaagtgttggcactcgaccattcaccattgtagacttcaatacctttgatcatttgctgatgatcaccaatggtatcggcaatcgataagtttttcatggtaatttcacgccgatcaacaagtaaggtccacttaatcgtgccattttctttatcaatggtgccttttttagacatattagcttcattagcaaccatattgatcactgatgtatcttgaccgtcttgggtatcaaacacaacgtcttgttcccctaagtcatcataacggtacttcattcccaggttaacatcaatcttaacattagttttaccttcaatcgccgaattcatggtcagtacgacctgaccatccccgccgacgacacccgtaccaatcacagtaccagtctcagcatcagtcacatcaaaagtagccccaacggtccgtggttccaaattagctggcatatcaatagtgactgtgtccccagctttgaaagccgtatccccaaaactcatttgatactgaatttgaatggtatcagcgtgcttaaaatcaggaccattgatgaccgatgcggcagttgtgtaatccttcgcatgataattagttgcggcttgggcccctagtggctgactaaatagtagtaaaattgcaaaacttactaacccaagtagccagaatagtccccgcttacttaacttcataaaaaaatccccctcgtaacataatatccttcatcgaaaagtatacgctagcaagatggattttcaatagaatttgtgaataaaacgattaatatgttcatatattgtttggtccccatctataccaatcaatgctcacttagagacaaactgattggcgcgtgtcgctgcaaattgcaaaatagttaccccgacaatcattatcgccccaagcagtccgacccagttaaagtgaacgtgcaaaaataagacgcttaaaatggttgctgctaggggttcaatagctcccagaacactagcagtcgttggtaggatgtattccaagctctgtaaaaagaacaagtaggccagcatcgtgccaaaaatcacgacgaagccgacttgcccccacgccacccaggttagctgcggcgagtggtgccaagcacctgttccgactagcaccaagccaccaccaatcagcattgaccaaccaacaatgggtatggcgccatacacttttaataattttgttggcattaatgtgtagatggttgcaccaaccgcggccaacaatccccagataattgcaattactggcaaagccagcgagtcagtgtgcccctccgtgacgattagaaccgtcccagcgattgctgagaccacagaaatgacgtccactttccctggaagctgccaagtcgtggcggtgataaagataataatcatcaccggtgacaagaattgcaagattgcggccatcgccgcattaccagtactgattgccataaaataagtcaattgaacgccagccatcccgaacaggctgaacacaatcagacgcaccgttgctcgccagtcatgaaacacggccacgaccggtaaccggcgactaaatccatataaaattaacagacctccagatactagcatccgcaccgccactaaccacaacggcgaaatcgttgtggtgtcaaatagatgttgtgccaccgttcccgagcttccccacaaaaaaggcccggcactggctaataacagtcccaccgttttcttttgcatttaaccacctccaaaagcactagccttagtctaacaagcaccagttaactttccaatggtcttttcaaattcaacttagaaagtccgactgacaaacctgccatcacaccactttaagcaccttatgataaatttcataattgacactgtaatggtggtaagctaatcttatagcggggtatggaggtgccaaatgaaacatcaaaaattaatttattggttggtcggaatctttgctgtcgtcttcattggtggcgcattaatcattccaacaccaaccattaagcaacaggttgtcagtattggcaacgccattacggggaatactaaaactaagggcgctacacacgccgtttcggatagtgcccttggtgaaaaatatcaattatccactagtgaaattcacgtcctgcgcaaacttaaagtgacggggatcggtgattcaatcatggtccgcaccacgagtgacttaaaacaaatctttgaccattttaacgttaacgccaaggttggtcgccaagtgtcggaagcaccagccgtcattaaccaattaaaagctgataatgcaattcagaaaaacgtgctgatcaacttggggacgaacggtccaacaagtgccgccgaaatcgatgggatcattgatcagattggcagcaaccaccagatttactgggtcaacacccgcgttccaggcaaagattggcaagaccctaacaatcaattgattgccgcggccgctaaaaaatataacaatgtgcatctcattgattggctatacgttgcgcaagacaacgacaactggtttgtcaaagataatttacatcccaacagtcttggtgaacgtgaatataccgcaacagtcggtcagacaatggctaaaacagcaacaccatagccactttatttttagacgagggttctgattacttgcattacccgtacagcagattagcccaactaattatgctaacaataacgtaaaaaagccggaacaccagtaattaacaggtgttccggctttttaatattggtcacgccaaaaattcaacagttatcctaacatcacttactcagtcagtaagcgatgggcgttatcgtaaaagatcgcttgtttctgctcatttgttaatagatcagtcgttgttaaagcgtgacctaattgccgcgagccatctaacggcgtatatggaatatcactcccgtaaagtaggtgctcaggctgagccaagctcattaaagttggcaactgccgtggtagcacggctccagctacgtcaaaataaacatggtgcatcacatcataaacatccacctgataaaccttctgcgcatattgtgcgattcgatcatcaacaattcccaaaaaagcaccagcatgcggtataatcaccttgatattaggatatttttcaaagaagtgatacttcaacatattaataaacgtcatcgtggtatccataaaaaatcccaacaacggcactggtaaatcaatatcaacgtttttaggcaagattgctggttcatttggatgtaaggccacaatcgcttggcgagcatctagttcttggtagacccgttccaagactggtgatccaaagtaaagtccgcgtgagttggttggcactgtgacgcctaaagcaccatcctggtccaaagcctgttgcaccgttttgacagcatccagttcataaggaattggtagactcgccaagtatcctaattgatctggatattgctgggctaagcttttaccatcgtcgttagccgcttcaactaagcgtagggtttccgccttatcgccgaagttcacgtgtggggatgataacgataaaatcgagtaactaatatcattatcacgcataaagttaagcgtaagctgtggtgtccactcaggtgtcggccagccatcaggatcacctggaacatgacgctttagtgcctcaacgtaactcgttggtaaatagtgggtatgaaaatcaatttttgacattatctgcacctcgttttttagaataaccatagtctaagaccaaacgagtgcgttggaaatgtacaattgatgtcaaattgaccatttacaggaggtgacatgatgacaactaactatccgcttgccgtacagaaaatgttcgcaactgtcccagcactactgacagtgacccccatctttaaattgactgtcaccatggtcgtcaaagcagcccacgttagtcgtgggagtttttacagtcactttcaagatatttacgacttcattcacgctttcgaacatgctttaatcgaacaagcaaccgtttcaaagcaagtccttaaccaagggattcaagctgccctggttcatccggacccgcataatgcttatccaacctatctggaactaacaacgaatatcaacacccaattggctagttttcaggccttgcttggcccccatggtgatccacagtttcttgatcagcttcaggccggtctcattgataatttactcgccactactgagcaggcgcccttaaatcatcaatatttccagtcgattccggctgactacgccatgccaatctactttagtggcgtgctgacaattattcagcactggctgactaaaccccatccggagccacctgaagtggtcgccaacattatcgttcagagccgctacaccgcggcttaccatctcttttccgaccgtccgcttggggacgataataactagaagccaaactaaaagctggtcataatcccataattgtggattacgaccagcttttagtcacgacagtcaatacttattatattcagtgcatggccacgatcatttgatcgccccacacttccaactgatgcagttgcttttgaaaactaacgcccgcagtcgtcaactgaaattgatagttccctgcagtcgcaactaatcctaattcggttaatttagctaaaacattcagtagtttaagcgtgctaagacccctaactcgctggcgcaaattcataatctcagttggcgccgccttcaggttgatcagcactaacgcggcccaccggtcattgagcacgcctaacccgactttcgtgccaatatttagatcacgcattaccatcagtccatacttccttacttagaatttataatcattatgactattctaagtaagtttgcgttggaatgcgaataacttgcttgccatcgacttttcagacttttatttttgaatgtccggatacgtctgacaaaagtcaacgaccgctccccgtaaattagcttcatcggtgaaatgacaagccacaacatctggttttatagaagcaattttgaccgttgcccgcaatttttcgatttcagcattgattgctgggagtagatgcggattattcgagaccgccccacccatcacgatcaattccgggtcaaagctgtattgtaagttgtagatggcccgcgctaaggcccgaaccataacttgaacttcagcttgagcatcaacatcacccttggcagccagttcaaacacggcttgcccgtctagctcaggttgagctggatggctcgcgttgtaccgcttcgcaacagctaccgcggtgcctaactcacttaagatctgatggtcattcatgagcgtgaatccaaactcaccaccgaataagtgcgcgccgtgccaaatttgatgattcacaatgaccgacccaccaacaccggttcccacaattaagaagcacaggctagcaacctgtttccccgctccatccgccaattcagccaacgccgcacaattggcgtcattttccatactgaccggtaattcaaaacggcgttgtaattccggctgaatccgaaaattatgaatatacggcagtgcgctggcaccctcaataattccagttgccttgttgacagccccgggcgaactaatgcctacaccagcaatttgataatcgcgtttcatctgcgcaacctgcgtggttagcaaagtgtaaaattcagctagcgttgtgggcgtcgtaactttggtcttagcaactaattgctgatcttgccacacagcaaacttaatggtcgttccaccaatatcaataactcctaatgactgcatcgttttatcattcctttatcaattaaactagttatcataacaatgatagcgcttaatcaataaaatgtatattcttttgtcaaacttcaaatacagtagttttcaattatctttcatgccctttaactagttgtatcaactacaaacaacggtctaagtcgatgtcagttccgttccaacaattgaaaatcacagaccagaccgcaaactaaacctaaaatactttctgattattttcatggaaataacaacttatcactattatattgtagtgttatgaccaactagatattttcgaaccctattcaataaagaagctaagcgaatcttaaaatcaagttaagcagtcctttttactatgacaaattgtccaattttaagggttcacttactgaaaaaaattcacttggagttttccattccaagtccttgcatagccagttatttaaatctgtgacggatgcggtaatttcttggtcattagatttaattatcatagttttgggaataggcaacagtaattccaaatcttgcatcattgaattattgataaaaacaccttttccatccaatatagaagattgcatgactaaatttccaaagatgacgttttgaatttatgaacattccaagaaatttaggtgatgttttatagctagacttgtttatccggtgaaacagtccataataaagctgtatcaaaataaatctacggaggcgtgtctacggctgatcaactagtattagatactcaacaatggttaaactccacgtacggtgacgtcgctggatttggtagtgttccagaaaatggtcttactggctgggacacaatttacggtcttactcgtggtttacagtatgaactgggaatcactgatttagttgataactttgggccaacaactgcaaagctctttgatgaaattgctgatgatattgtacctggttattctggtaatatcgcatatattatacagggtggtttctggtgtaaaggcattgattccgccgcttttgatggcgagttcactagcgatactgcatcggcagttacaaccatgaaggaatacgctggattaagtgatacatccggtaccctggattctcagttcatggctgccctactcaatatgagcgccttcaccctggttgcggatggctatgaaaagatccgtacgatgcaacaacaattaaatcatgactatctcgcctatactggcattctaccctgtgatggcgtttatcaacgcgatacaaacaccgctttgatttatgctttacaagccgaagaaggacttgataccgacactgcctctggaacttatgggccaatgacgcaagaactgactccaactgtttcaactggtgataataataattttgttcgtatactacaatggggtctttatgtaaataatcaagcgtatacgggggcttttgatggcagttattctttagatgtatcaagctcagtagcaacttttgaaaacgatatggccctaccagaaacaactggtgcatcagcaggattggacgttttcatgagtcttctaacctctgccggtaaccctgaccgcgatgctgttgcttgcgatacgtctcaccaaattgatgctagtgaagccgccgcacttagctctgctggttacaaatacatcggtcgctacttaactgggacagccggtactggaagcagtgaggttgataaaaacctaaccaccagtgaaatcagtatattaactaatgctggtttgaaaattttccctatttatcaagacggtgcatccgatgatgaagactacttcactcaaactaagggcagtagtgatgggcgtaaagctggcttagcagcgatgcaattaggtttcccggatgatacaattatctactttgccgtggacgtcgatattcaggatggtgacatagctggtacggtcgaaccatacttcactggcgtggcaagtgggatcagtagtttcgggtttcaagttggtatttacgccacaagaaacgtcgccaatacgattattgtggatggattagccgaaaaagcttttgtatccgatatgtctactggcttttcgggtaatctcgggtttccaatgcccagtgaatgggcctttgaccaatttaatgaggttgcttttgatgatttttacattgataaagtagcttctaacagtagccgctcgacggcagtggatgacttctcagctggtagtagcgttggtggaagcgatgatttagacgcaattaatgaaattattcagaaactaggcaatacaaatacttactttaattttgtgaaatccgtctcagttgaagcgtttagtgacacgtacattcaacacccgctgctgatttttctttaaaagttgatttagaaggaagcattagtgacgacgatggtaccgtgtcagcgacatataaggtaaatgatggtagtaccagtttttctgttagtgatgcagtccaagagttacttacacagaatgaaactgcattaggttcatctgatatgacaaatgctatgaacgaaattgcgggtgtcataaaaaatggtgatatttcaagtaatacatctattaaaacttctctcatgacgattaccctgaaaattaaatcaacgtttgagcacactgccagcaatgggaaaacatattctattgaatatgaaattacacttgacattcacttccatgaattcacagcgcccctaccagttaatgttactcaaactcaggcaactgattataataataatctaaagactattttgagtattcccgcaaatgctctagactacattaataacttgcatccagatttacaattcacacccacgccagcttcaacagaatcgtccttagcagttatgatgatgttcattatcactttgttagcggctgttgcttgataataacggttttgagtaccaaaaattataattaagaccatgtaagggggatgcaaatgcaatctaactcggttgcaaatactcttagtactgtgattttcatagcgttaataaatctctttataatagggctagttattctttgtttgccaagcattaagatgcgagccagtttcttcaacctccgagcacgtatcaacgccagaaaaaaatatttattagagccactaaaaaataatccaacagcaaagaagtacctaatcggctattttattagtagcttcatagcggctctcagtactggaggacaaattttcataatggcaaatggatatccagtggaggccacaataattaattgcaccgcttatggattcacttggtggttcagtcgtacttcaaaacttacgaggaattattgggagcaaaataaaagtgggtattcagagtttcaactatcatcagctaacgttttctggcttaaacagattcttcttaaaactattttagtggatggcatgattattagcatttcattaatgacatacatggtttgtttcggccataaccgataatagttgctgcgcaacactattataatcttcactagaaatcaatatgctctgttcagtctaacgacagaaaattgacttggctataataataaattgaagggtcgccagtgatggaacctttcgccttacatatctaaaagctagctttctgaatcacaattaaaaggtcaccagaaatggtggccttttaatgtgcgcttttgattggcaaactgtgtttgcatgattcagttgttgcatataattttcaaatcagcaatccgaactcagcaactatcttagttataacacctacatttggaaagattgagctttgataatttccatgcttccaaattcagcgtcttcattcaaataccagccatcgcgaaataactggctcaatcactcatttaagctaatctatctcccaaaatatctgatatctattaaatcaacaagtcagttggatactatacatcaatatctcggtaaccaactatttttagttaatctttaaattgaattttaacgtaatcccgatagagtgggacgttcgccatcagctcttgatgcgtacctgaaccactcacatgcccatcttcaatgaagtaaatctgatccgcatccacgattgtgctcagccggtgggcgatcactagggtcgtccggcccttcattaattcgccgagggcttgttggaccatcgcttctgattcagagtccaaactagcggtcgcttcatcgagcatcagaattttggggtcccgtagaaaggcccgggcaatggctaaccgttgccgttgaccaccactgactttaaccccacgttcgccaacttgcgtctcaaggccatccgccatggcgcgtacaaagtcagccgcggaagctaattctaagacgtgccacaactcattgtcagagtataaccgatcagcaccgtacgttaagttttgacgaatcgtaccggccatgattgccgagtcctgactgacatacccgatttgtgaccgccaactattgagacttagttcattaacatcttgcccgccaatactaatttcaccagcggttggttgataataacgttccagaaggccaaagatagtcgacttaccaccaccagacggtcccgcaaacgccaccactgtatttggtttagcttcaaaactgacatcgtgtaaaatttgttgatcatcatcataggcaaagtcaacatggtgcatcgccaaagtctcattggcgactgcgtgttcaacaccaaccgtcaattgttcttctggttcattcaacaactcccgaatccgggccgtcgagccactggcctttgctaacgtggtgaagaactgaccaagcatcccagctgggccaatgatttggaacagatacattagaaatgagaccaaagtccccatcgtcatcgttccactggcaacccgcgcagacgcatacaatagtaccccgacgaataacgccatcatcgttgccgtcatcactggacttgagatggaatcataaatggcttcgcgtagtccaattcgatacaacgtcttaatctgatgtgaaccagtcgttgtttccactggttcagcattggacgatttcactaagcgaatctcactcagcgtttcttctgccgtcccgctaaaattagctaaagcatcttggcgttcatgaccaatcttgcccgtctgccgcatgattggaaacatgactaataaaacaactggaatcgccaagaccataatcaaggtcattcgccagtccattaagaccatgattgcgatggccccaaccaattgcatcagtgacgtcacgacttgcggaaaagcgttagcgagcaagtctttgatctgcgtcgaatcattcaccaaccgcgacgtcatttcacccgtcttaacgttgtcaaagtagcgaaccgggagccggactaatttatgccataaagtcccccgtaaattagcgacaacattttcaccaaaaatccccaataaggaacctgataacgcgctaatgactgcactgatcaagaataagccaatcacaccaattagtaaggtctgattaacgccgtgactaaacccattaatcaacgtttgggcaaatttgggcaccatcaactgcgcaccagtcgccaataagcctaatgccaagcccaaccagagttgccaataacgagggctagcgtgccgaatcaattgtaagaattgttttaaatcaaatttaccacccgctggacgcgagtatgctgcttgtggtcgttccatctgctcttatgcctcgtgtttctaaaatttaattaaaccaatgatgcccatgaccccaaccgggacgtgggccaaaaccgtgttgttgaccaaattgcattaaatcttgaatatcgatgtcatccgcattggcccgcaacttatctaataagtgttgtaactgatcgcgctcatcatccgtcagattgccaaataactgatccgccagatcactcgttccttgcgcgcgatggtccgccatctcacgaccacggtcacttaaccgcacgatcaccacccgtttgtcatgcgcacttggttcgcgttcaatcaagcccccgtcttctaaccgattcaacgtggcactaactgaacttggtcgaatatccaagatctcagcaatttcagcattggttaaaccagcgggtgcatccgccaatacccgtaaaatgcccatttgaccacgcccgccacgctcagaaccatggtcgccaaaatgaaattgttgcgcaaccgccatgacgaaagcccgattctgaaacaactttccaaaactactaaataaatcacgattattaactgtcatgaatttttgtcctccttgatttgaatgatgcttatgttagcacgatagttagataaatacaacaaaagctaactaaaattctaaccaaaagtccaaaaaatatctcaagccctattaaatcaaggtttgagatatcaaaaggttagctcaattaaatgaattcggtaacctgcgtgccagcgtaacgcgttgtcgtgattggttcgctagctgccttgccaagtgcaatagccatcactggtacatagcgcttggcatccaagccaaaggtcgtcgcgactttatctgccgcataacccgcaattggattagcatcatagccatgtgcgcgggcaatcaatagtaattgcattgcggccatactactatcaatcatcgcatcagcttgtagaaattctggactcgcattttcatacattggtaagaacgtcttgaagatttgatcccgcttttccggggtaatgcgtccttcttcacaagctttattccacacgtcccgatagaccaaatgcgattgcgtatcgcccaggacaaaaatcatggctgaacaagaatcaatttgtggataattaaatggcattaaaaccgacttcgcctttgccttaccgtccgcactatcggcaaccacaaaatgccaggattgcaagttgcatgctgatggtgcgctgattgtctcatcaataatcgtttgcaattcttcacggtcaattttgacagtcggatcaaactgccgtactgattggcggttaaacaccacgtctttaaaatcattatttttaatattagtcgtcatggttgttggcatcctaaacaactccttttttaaaagtaacaaattcattaatcaatcttattataactgattttgtatttgttttcacaattattttgaaatcgctatcattagcacctattattccgaccaatatttattttttatgctcattacctggggtcatcgtttataccagtattacttatgcttgtcggacttgtagttccgtatttgtatttatattagaccactcccaattgtactgttaatcttattaaaccaatggactataccaataaaaagcggttgtaatagcgctttcagcaccgtacaataatgattgcacttattcaaaactatctttttagggggattttgtacatgaagaattatttgcaacgtatgggccgttcactgcaattacccgttgccgttctacccgcagcagctttacttgtgggaattggtaactggtgggcatctgctagtaacgacatcgtcgcacacttcttacaagccggtggtaacgctgttctgagccaattaccactactatttgcagttggtttggcactcggtatgtcaaaagataaagatggcgcagccgctcttgctggtttagttgcctttgaattaccaactaacgttttaaaatcagaatcggtcgccacactcttgaatatcaaggtagccactgttaatccagcgtttggtcaaattggcaacgtcttcattgggatcatctctggtctgattgccgcagctctttacaatcgcttccacgagaccaaactaccgatggctctttcatttttcagtggtaaacgtctagtcccaatcttagccgcgctgaccatgttattagtcagcgtcgcgcttctcattgtttggccgcccgtctatgatgcgttagttacctttggcaaattcatcgtgggtctcggtgccgttggggccggtctctatggcttcttcaaccgcctattgattccaactgggttgcaccaagcactcaactccgttttctggtttgacgttgctggcatcaatgatattggtaaattcttagcacacaaagggatcaagggtgtgactgggatgtaccaagctggtttcttcccagtcatgatgtttggtttaccagctggggcctacgcgatttaccgcaatgcgctaccagaacgtaaagttgaaacggcgtccctgatgatggccggtgcgtttgcgtccttctttaccggtgtgaccgaaccattagagttctcatttatgttcgtagcttggccactctatgttttacacgcaatcttcactggtttatcgctagcctttgctgccttcatgcactggacagccggttttgccttctccgccgggttagttgactacattttaagccttaaaaacccgattgctaatcaacctttaatgttgatcttacaaggattggttctagccgtcatttactactttggctttgacttcgcaatcaagaagttccatttgatgacaccgggccgcgaaccagtgacagccgatgacgccgatgatttagccatcgccactgatgcggatgatgacaaatacacacgtcaagccaagcaaatttacgctgcgctcggtggtgccgataatttaacggttgtcgataactgcacgacccgtctccgattgcaattagccgatacgtcaaccattaatgaagccgctatcaaacacagtggtgctgctggtattaacaaattagacgaccataatctacaaatcattattgggaccgaagtccaattcgtcgccgacgcgttgagccgcttaaagctcacgaacgcacccattactaagaccacgactagcaatgaagctgttgcgacagcaccaactgcgactaatatcactagtggtgtaaccaccgacttttacagcgtcgctaacggtcagtacgtagatattgaaaacgtcgacgacgacacatttgctaagaagatgctgggcgatggcttcgcaattgatcccgcagacgggacgattacggcgccggtcgacgggacggtcagcaccgtctttcctaccaagcatgcaatcggttttaaaaccgattcagggtttgaaattctgctgcatatgggtattgataccgttgagttgaacggtgctccctttgaagtactagtccaaaccgatcaacccgttcaccatggcgaagtagttgccaaagctgacctggcagcgattaaggctgctggtaaggccacaaccatgatggttatcatcactaacatggatgctgtcaatttgatgaaattcaagatgttgaccaaccaagtcaaagtcagtgatgagattatgttggtcacgacgaaataacttgttgcatgcgccaattatatgaacagccccctacgtatttgatacgcaggggctgttttcgataatcaaatcgccggacaattctttaaattttccttaacgtaactcatttgccatttagcaacgtttaccggcaattatggattattcaattaacttatttttccagaattatacgtcatatgaatattatcgccacgaaactaatatggtatgctaaaacgattgtcacctagcctcggaagtcggacgaacacatgttgatgaactgcaatctaaactaacagcacgccttaatcatgatttgcacgaagcggtgactaaccgaacctacaataattatattttggtattgctcagcatgcgctaagctagaaaggaaaaccaatgtattttggcgatttaattttcattatatctatcatcggtggtctcatcagtttaggactgatcatttatttgattgcgaaattcgttaagtaagataatgacctgctaactgatcatcggccgttgcgagtcgttttttgcaacgacagcctcacacctcagctgcgaacatcgtcaccaagtcatccgtccgcaatgcttgcttttcggcaccacgcacgtccaacttgatctgaccatcctgtaccatcactagccggtcgccgtatgtcaacgcatcgctcattttgtgcgtaatcatcatcgttgtcagatgattggccgtcacgatttgttgggtcagcgccatcacttccgcactcgtcttcgggtcaagcgccgccgtatgctcatccagcaacaacagctctggttggctcaaggtggccatcagtaaggataaggcttgccgttgccccccggataaatacttcacttgcgtattcagtcgcgcttctaaccccatattaagactagccagcaaccttaagtatcgttcttcctgtccacgttggcgataacggcgcagactcaagctccccgtatgacgttgggctaacgtgagattctgggccacacttagttcgccagcggtacccaacttaggatcttggaacacccgggccacccaccgtgaccgatacgcaacgggacgattggtcacacgatgattggctagtgtaatctctccagcatccgtatttaacgttcctgcaatcgtattgagcaaggtcgacttgccggcgccgttgttcccaataaccgccacaaattcgccaggttcaatcgttagattcacgtcctttaagaggtgccgctcgttgctggttccgggaaagaagactttttgcaagtgttggacgttcagaatagttggttgtggcatgttgatcgactccaatctctttaaggtaccggcgtaactgccgttttgtccggtatttattttgtaatagtggcaagcagatgacgatgacaagaatcgccgctgataaaatctttaagtcattgacggggaaacctaagcctattgccaaagtcaacaaataacgatagataatggcgcccacgaccattccagtcaaacggacccagatttgacgaccatgtaagaagatttcaccaaccaggactgaagccagcccgatgacaatcgtcccaattcccatcccaatatccgcgtaaccgttactctgtgcaatcagaccacccgataaagcaatcaaaccgttagataacatatagccaataatgaccatccgatcggtatagattccattcgcagcactcatcgcaggattattacccgttgccatcaaagatagtcccaaacgcgtctggaataaccaaatcaacccggccaggacgaccagcgtaaccacagacccaatcacgatggtttgtaaattcaaagaccagctcgctggtaaccatcccatcaacgttttctggtcaagcaagggaatattcgctttgcccataatgtgcatgttgatggaatatagtcccgtcatcgtcagaattccggccaataatgacggcattttaagcttagtatctaatacccccgtgacccaaccggccaaacatccggcgacaaatcctaataaactcgccacgatagctgactgtccggccaacatgctactaatcgtcacggcagcccctaatggaaaactaccctcggtggtcaaatcagggatgtttaaaattctgaaagtgaggaacaccccgataaccagtggcgcccataataaaccttgtccaatactcgtgattaacatattacctcgctcccctcttatggttgcttgattgtacttggttgtaagccgattgccttagcattcgctttattgacgtagaggtgtaacttgtcagctgtttgaaccgccattgtttgcggcttttgcttcttgattaagacttggtaagccatttttcgagagcgtaaaatatcttgtgtaaatgcataaaagatttctgaattgtatagaaatagggaatgccttcccttatgatatttagtaaccacagaaaacatcacaggaggcattccccatgaatgaacttaccacagaaattatcgctgcactagcccaaaagcaagatttggacgaagtttttcgtcaccacctcgaaattgcgattaaccagctgcttcaaaccgaattggcagagtttttgggttacgaacgctactcatacgctgggattaacactggtaataaccgcaacggcagttatgagcgctcgtttgatacgaagtacggccaacttaacttaaccattcctcgagatcgcaatggccggtttgaaaatcataccttgccagcctacggtcggcacagtgataatttagaaacaacggtcattcagttgtataccaagggaattaccactgctgaaattgccgaactcattgagaaaatgtacggtgctcactactccaaagccacggtttccaacatgactaaagccgtcaatgaacaggttcaagctttccagcaacgtcgactggcttcacaatatgcggccatcttcttagatgccacttacttgccgttaaagcgggataccgttcaaaaagaagccgttcatatcgcgattggcattcgtccagatggtacgaaagaagtgctgaactaccaagtggcgccaacggaatcgactggaatctggactgaactgctgggaaccttgatcaagcagggcgttgaagatgtgctgttgtttgtggccgatgggttagttggtttggatgaaggcttgaatcggcatttccctaaagccaaacgacaacgttgcctggttcatgttgggcggaatctgatgaacaaagttcgcgtaaaagaccgcaaggccgtgatcagtgactttaaacaagttcatcgggccgccaaccgtgaagcagccgaactgaaactgaatgagttcgccaacaactggcatcagacctatcccaaattaatcaaagatctgcttaaaatgccgaatttactcactttcatggactttccaccagctatccggcaatcactatactccactaatctgattgagaactttaataagcatctcaagcgcaccacccaccacaaagaacaatttccaacggaagattcactggatcgcttcctggtttctcagtttaatgtttataacgagaagtctctgaagcggatccaccgagggttcaaaggactccaggacaccttggaagcatcatttatttaagttagatacatattatatgtacgaaggcatttcatttacacaagattcttgacgctacccatttttccagtctgttcacctaattcgtaatagttaagaccatacgtcgcagtcccgccatcttcagccatttcaatcgaacccgttaccactggtagctttgcagccttggtcttctgaccaatcgtcttcaatcgcactcgccatcaaattatcggttggtaagtaaaggccagatattttacccgtcaaaccggccaaaacactggcaacgtcattagtactcgttgcgctaacgacctttaagttgataccgtgctttttcgcgtaagccttcgccaacttgacttgtagcactgaattttcttctgacgagttatacataatccccaacggtttattacctgtactcatattcttcaataactgtaattgtttgccgacgggcattaaatcgctcgtgccgctcacattagtttggggattcgtatcacttttcaccaaccccgccgctttcaaatcggttacggccgtaaccaaggtcggcaccgtcgtcgttttcttggctaatgcctgagcagctggcgttgcgatgccaactaacaaatcatttttctgttggacgagttgttggctcattgtattcaaattactctgatcaccctgtgcatttagatagtgatacttgaccgttattttactgttatgcgcttttaattctttttgtaatccggctttgaagcccttgcgcgcttggtctagtgaaccatgttgaaccacctgtaagatgcccaccgacacgctttgctgaccactcgttgcttgtttgccacaaccagctaatagtaacccagcacctaaaattaatacccctaaagttgtttttttcatcttgaaacgctccttaaaaattgcctggttcgcccaacgttcatcaacgtcttgatgaaccggactgaaaacaaaaaacaccagttagattctgggaagaatctaactggtgttttatcgggcccgatatttttccagatagattgtccctgtatctacctggcgtttaagtcatgttgaataactttagctctcgatagatacaaacgcgttgcgtgcgcttgtatccatcaaacgaatacaaacgctatctaaagaaaaagctaaaggcaaattgattatttaattgaaggttagttgctaatgacatattagtcatcctccgtttcaatttatagctaatagtaaaccatgacgacacctaacttgtcaactgcgaaccagtaaaaaattcaagtgtaactggtcaaagtccccgtcacccaactgatacacgctaacttatttatctggcgtatcactcagagtccaactcaaggtaccttgataagtatcagcgtaaatacctggttgcgctgataatccgattcccttcgttgtcgaccaatcgtcagtgactaccgtatcggtcgtccccgcgactttttgtccctgttggaccaacgtcgcttgattcgttaagacggtttgtgcactaccatcacggtaaaacaaatcgcccttcaacgtccgtccactgaccgttgtcgatgtcagcggcgtggcactaacgtacaaataccacttagccccggtcgcccgggtatcagtcacactgatggctagtggattagtcggttgatagacttgtggtgtcaacggcacctttaaatcgccgaagctcatattggtcgttaattgaccaaacgacagcgtccctgctaacttagttacttgtagcgcaattttatcagatgttaagccgctggcgctcgtcgcatagatgtggaccgtggtactctgattatcagcgagccccttgaataacgcgaccagaccgctctcactcgcatgataagtcatcgtgtcattagcgttactaggattcgtcgcaaccacgccagcctgcttaactaaccaattaacagcatcgctatcagacgtcaacgccgctagatcactcacggacaaattcaccgctgtgctgctacttttgattgtcagcggtggtatcgtcacgtccttagtcaccgattcggattcgccataatcggcttctcccgtctgcgttactgtgactgaagtgaccccactgaggccatcatttaacttaatttcatatttgccatcactaccgattgtcgccgtgtacgacttaccattaattgtcgtgctgacagtattaccggcaatcccagttcctgtcagagttgtatccgtcgttgttggtgtgttcaacgtcgtattaaggctaatccgattaaacactgccaagcggtacgtggatgtctcaccctttactgtagttaatcgaaacccaatatatactggcaaattatcttttaacttactcatatcgactgtcaaagtcttgctagtattcatcgataccgtactagaaccagtcgccatatttgtcggagtcttggtcactagtgaagttccaaattcttcggttgcttgcttataaaagacatcgtaatatagcgttttaatctccgaactattcgcaaacaacgaaccactaaaggtcaacgttattgtagtcgtcttggtcgatatgcgcccctgatccgcataattggccgtcactttggttaagcttggatatgtcccaattccacccgagatattgaacccaacgacatcaccgctattaaagtaagtgtagtacttattactcgaattagcgattgtcgttgtcgcagacgtcacgggcgccgctgcctgactcgtaatcgctagcatgctgataaacgctaagcagctcagtaacagcatgcctagcttaatatgccgcagtcgtttcacgtgttcgcccccctttcacgcattaacttaagcacctgccaccctaataagagtgccattaaggtcaggaacccgagccactgataatagtgattcgcttggaccccggtttggggcaaacggcccgttgctagtacctgttgccactgaccgacaaagcgattgggcgtggctttgacagccttctttgcgtacacaacgtcgccctgcggaatttgttgcaccgtcgtaggcgtttgtttgtccgctgaacgtgacgtatagaactgtatttgtgtcgacgaagtgcccaccgtctgagcagctcccccgatggatggtcctaggccgattaataagcccagtaagccccgtatcaacagccatcgcatcatttgtcagtcccccttttttacccagctactaattgttcatgacgcttaacagtcccaaactaaacaccgagccgattgctgttaatcttgagattgccgccgcttcttcaagaaaagcactaaccacaaaatcagtaagactacaatcaacatgcccagtgcgcccagaccaatcaaccaccagatactgatgccgttatcatcaaccgtatcctggttatacgtcttagccgtggcagcactaatcttgaaatcgcggtcaaaagtccacttatgagcgctattgtgcgcaaccaagtgtaaatgatacgtccccgcttgaagcttctgtttgttgagtaacagtgggtaattaaacgtcgtattaggcgccaacatcacaccttgtttggtcgcctttacgacggttttgccactatctttggctgtgaccgtcgtcttcatggtaacccgtggtatcatcactgctgcagtattgcgtaacgtcaccacgatactccggtgataattaaccattccagcagcgacatcgcttagtttcaagacgggcgtgggcgcagtccctaagctgtacttgatgcccaccacataagaatattcactgctaatattcgtagcacccttcacttcaccagtgaccttttgatcgacgcgtttaaaataccaaccacctaacagggcaccgttaaaatccttagtcggcatggtcgtttgggcactgaccagcttagaaccgttggctggaactgtcaacgtcgttggccccttgattttagtcaattggtcgacccgatactgcagtgaggcatcatactttttcgccggggtcacgtattcaatggcgccaccactgttggtatatgccgtatgaatccccatcgcaacgcggatatcccggttagtcgtattatagattcgcgtctgcaacgtttgggtctgccctgccgtcattttgaggtcaaaaaacgttgcctgtttatcaatttggtttctcggcgtttgggccgcgacactaaaaccaatattattactggtgtccgtattggctgcctgtgctggaaccaccgcggccaagccgctgatcatcactaagatggcccctaaccaccgcatcattttcttcattattgcgtccccccgtcgattattatgtaaaagagacgcccactattacgtggtcatctccaagttcattaatttaattatctgctgatgatgttaatgtccaatttaggacgcccttgtaagtcgtagcggccgccgtgttagccacgacgttcaacttgactgcagccggatcaagcaagtccgacgtaatccccgccccactcttatccgctgctgtcataacattcccagaagttgtccccgtaaaggacgccccggcactagtcgaagcttgactacctaagtcaagttcaacagcttgtccgaccgcaccattaccaccggtactgccgttgctagcttccgatccggaagaaatgaccgtccctgcaggtaaggagaccgtggcccccttaagcgtacttaagttaccatccgtgccatccgcagcggcaacactcaatgtccaacccgcattcgtcccgcgttgatcagagacttgtaaaccaactttactcgttgaccccatggtgaccgtgctaccatcgctatctgttaatgctttatagctttggttattgatcacgtcaatttcatgtgaaccgaaatcaagtttaccgggcgcatagatcagtgacaaaccagcaccggaattggcaccgttatcgccatcaccaggcttagggtcaagtggtttcgttgggtcagtcggatcgaccggatcaactggattagtggtatttgccgtaaacgttgccgttgcattcgtcgtcccactccgattttcaccatcggccgcgtgaccaacgattggcgttaaggcccccaataaaatggtactggtcatgagtaaactgcctactacttttttcatatcgtgcatcccctttagtttgcctaattcattaactgcactaataatttaccacacttcccaacaattacaaccccttaatctttgagttgcttctttgttaactcgtgaaaatcaaccaagtcaactgttacggccgtattttgtatgcggcattaattttttgtttcatcatttttgcattaaaaaacgttctatccgctgtttttctaatacttgtacaacattaataaaacaacagatagggatttgatccaattaataataattttttttattgtcacgttcaggtcagtctcgttcttcttgatcagtctcggtttgctatcaattttattatccggtcttaaatttgtgtgtaccgctcaaaaccgcatggtaataacgaactcaatcagttatcactactcctcacaagtactagttagttgccgtaatttcccatcagctagcgaatgtcctgtctataaaacattcagtcgaccgcagtcttaagtaacaatacgacaaaaaaaagactcaggattgaatcatcctgaatcttttttgtgcccacacactttcaccacgccctataactttgtacaacgcgatgtctttagccacctaatctccaataatagacaatagccgccagagctaatcactgaccggttgtacttcaaaacctgctgctgtcaagacttggttaacatcggcggcctgttcactattcacgtggagctcaatcactttttcagcctggtgatttacgaccattaacgtctgaatacttaaatcgtgttctgttaagacctttccgatggcaaaaattacgccgacatggtcatgatggaccaccacccgagttacgattcccggctggccgtaaccagcaatatttaagaacgcatccaagatatcattattagtaatgatgcccacaacttggtcgcccgtcatgactggtagtacgccgatcttatttttccgcatcgttgcaatcgctgtttctaactgagcggttgctgcgacagtttgaaccgccgtttccatgatttgatccaccgtcgtcttagtaagtaagtaatttaattcatacaccgacaaactcgtggcctgtgatggcatcgcacgctgaatgataccatgcgtgatcaagccgaccattcgattacctgccatgacaggtaaccgatgaatcgcatttttcttcattaattcgaccgccacactgatcgtcgttttaggactaacaacgaccaggcgtggtgtcatataatctgcaacactcatacttaaccccctagataagctttctgaacttctgaattagctaataattcggaaccccgaccactaagcttgacttgtccactagctaagacatagccgcggtcagcgattttcagggcttgattggcattttgttcaattagtaaaaccgtcgttccagcctgattgattgccttgatgatctcaaagatctcattaataaagatgggcgctaatcccattgaaggttcgtcaagcaacatcagcttgggctgcgccatcagtgcgcggcccatcgccaacatttgttgttcaccacctgagagcgtcgcggcatcttgatgccgacgtttcttcaaaattggaaagtagtcgtaaacttgctgataagtctgagccaattgaccccgatcctgccgtaaaaaagcacccatttgtagattttcttgaacagacaggccgggaaaaatatggcgtccttcaggaacttgcgagatacccgcccgcacaattttaggagcggccgtcttttggatgggttgatccaaatagtgaatagaaccactgaccggacgcatcaagccagatatcgtgtgcaacaacgtagatttcccggcgccgttagcaccaatcaacgtaacgatttcaccctgttgcacgtcaaaactaacacctttgactgcctgaatcgcgccgtaattaacgactaaatcacgtactttaagcatttacacccctcctagataggccttgataacggccggatcatgttgaatggcttttggcgtcccagttgccagtaacgccccgtgctccaacacgtagagccgctcgactacgttcataactagtgacatgtcgtgttcaattagcacaacggtaatatgaaattcttgttgaattcggcgaatcaagcgcgtcaaatccgccgtttcttcgggattcatacccgctgcgggttcatcaaggaagagtaacttgggcttcgtcgccagggcccgcacaatctctaatcgccgctgaataccatatggtaaactctttgcgggctgatcagcgacggcggtcaaatcaaacatcgctaataaggcttgcgccgcctgggtcattgcccgctcagtctggtaatacttaggtaagcgcaggatgctagtcaaaaaccgttcatgataatgattggtcattgcaatgcgcacgttatcgagtacactcatctccttgaacaaccggatattctgaaatgtccgtgaaataccaacccgagcaatcgcagcgggctgcttgccatttaacgacaccacgccctgatctgtgtagaaactaatgctacccgaactaaccggcgtttcaccagtcaacaagttgaataacgtggttttaccagcaccattcgggccaatcaaaccaatcagctcgtcttgatcaaaatggagtgaaacgtcagcaacggcggtcaggccgccaaagtttttgaccaacccttgtgcgtctaataaccggctactcatggttaaccgcctccttagttgatcgccgtctgaatagacgcgtgaatgagaactcccacgttcctaacagtccggctggcttaaaaatcataatcaaaatcagtgccaatgaataaataatcattcggatcgtaccgaagttttgtaagatcgtgtcgagcgctcctaatacgattgcggctacgaaagtcccggtaatactgccgaccccaccgagtacgacaataatcagaatcgcaatggaagccatgatattaaaatcacccggcgcaatcgtctgaatgtaggccgcgtgcaacgacccaccaatcgccgcagtcgccgcgccaaagacgaaagcggccaacttccagcgcgtcgtattgattcccatggcaccagccgccagttcatcatcccgcacagccatcacggcccgaccaccgcgactgtgaataaagttgaccgtgataatcgttgtcagacacattaagacgtacaccgttgcccacgaagcaagtgccgggatattgaataaccccgctgcaccgttcgtaattttcagattattgattagaatccgaatgatttcggccgcccccatcgtcgcaatggctaagtaatcaccgcgcaatcgtaatgttgggatgccaacaatgaccgccgctaccatggcaatcaccatgccgacgatcatcgacagataaaatcccgcgggcgtcgccattgtttgggtcataataccagtcgcgtaggcgccaattgccataaagccggcgtgaccaagcgagaactggcctgcaaacccaataatcagattgagtcccaccgccaatataacgttgataccaatcgtcaccagcatattttcaataaacgagttaatgacgcccatcagctctaaaccgtcaatcacaacaaagccgataaccatcacaccgagccacgccatgttagttttcaaatttgctttcattaatttggcgcctccctcagactttttccttggttcgtttaccgaatattccagccggcaacacgagcaaaataacaattaagacaaagtaaaccaccgcgtccttgtatgcggataggccaatcgcctgaacaccagtctccaggatgccgataataaagccccccaatgaagccccaggcacggaaccaatcccaccaatcacagctgcaacaaaggccttgataccgggcgtcatgcccatcaacggatcaatcgaattatagtataggccaatcaggactccggcagcgccggccattgcagaccctaatgcgaacgtgaacgaaatcgtatggttaagattgatgaccaccaactgtgcagcttcgggatcaacagaaacggcccgcattgctttacccattttggtacgtttgataattaattccaatagaatcattaataggcacgccgttcctaagatcagtagctgcacattcgatacccgcaatccgccccagtgataagtcaccactttgattgcttggggaaatgaacgggcactcgcaccaacaaagtatgacattccattctcaagcaagaatgaaacaccgatcgctgtgattagcgcggtaattcgcggtgaatggcgtaatgggcggtacgcgaagtattcaataatcacaccactaactgcgcagatcaccattgcggacaggagcgccgcaataaagttaaagtgtagtgattttaaactgtaatagccccaaaaggcccccaacatgtaaatatcgccatgtgcaaaattaattaatttgataatgccataaaccatcgtgtagcctagcgccaataacgcgtagatacttcctagcgatagtccgttgatcaattgttgtccaaatgtctgcatatgtgttcccccacgctttcgctagtctgactatttgacgttataaaccttgctgaccacgccattcgtcaattgttcaattgaaatcgtcttttcaggattatgttgcttatcgatggtcgtcgttccagtgacacccttgaaattcttaagttttgccaaaccatcggcgattttaacggaattagccgagccttccttttcgatggctgctttgatcatataaaccgaatcataagcgagtgctgaaaaagttggtgcggtactaccatactttgccttgtaagcactcataaatttcgaagcaactttgttcgttgccgaagccttagtagaaaatggcgtcgtgtaataaacattggtagcattagacttgccagcaatttgggttaatttagcatccgccatcccgtcactaccaccgattggagccttgattcccgcttgccgcgcttgcttaacgattagaccgatttctgaatagtaaccaggcgcatagatggcatcgatctttttatgtttcaacgcagttaggatggcattaaagtccttatcgccctcttggaacgtttggctgctaacgaccgtgccccgatactgcttcttaaacgcctttgttaggcccgtgccgtaatcactggagttatcagtcaaaatggcgacgcgtttcgccttcaagttcttagtcacaaaggttgctgccgtggctccttgaaaattattctgatagcaagctcggaatatgtacttttgaactttgccactcttttgcaacgtataatccggatcggtcgctgatggactgactgatggtactgccgccttagtcatattagggatcgccgcagtcccggcgctagttgtcgcgggaccaactacggccacgaccttatcgttattcacgagctgggcagccacggaagcagcagtcgtgttcgatgtcttattgtcccggatcaccaactgaattttcttcttggtccccccaaccttgattccaccgctcttattgattttcttgacggctaactgaatgccttgcttttgctgttctccataaccggccgcagatccagacaattccatattgaccccaattttaatagtcttgccaggattatttccttgacttgaacttgatttggcagtggcacaccctgccagtgtcaacgccatcgcaccaagtgctgcaatcttcatcgtttgtttttcccattttttcattagttattcccactttcgtttttttattgctacgttgttgaccccgatcctccttaagtcacaaaaaggcctcatccaccgtagtgaatgaggcctttacccggaactgagcctcattaccacaatgggaaagaagggctcagttcacttgaattttgagttatactcaaggtcaagtgaccgggtccttcttcgttaataataaggctaaattttgaacagcaagggttgtcaacaagttggttaggttagattgaattttcataattgacgcgcctcgctttcaaaagtttttgtaatgttgatgtttcttagattaattaacttttaattataagtcaagtgaatttttaattgtttttatattaattaaaaggtaaaccactacgggctcatagtgtcgacagtaattcaaaaaaattatttttggtcttgattagcttcggttgagaggcccccctgaccaaccagcttattcagccggattaaaagcataaaaaaagaactgattactaaactggcaatcagttcccattcaaaaattaggccgtcatggtcgttattctagttaagcctttaagagtttttcaacttcgctcttgagcttagcttcgtccatactcatataaggcgctacttcgtcagccgtcttgtcagtatcatgactatcagcgtccataaagtgattccaaatcgcatcccgtacgggtaacttagagtcgctccaatcaaacacgtccgtcatcttttcgtctaacatactgttcatttcaactgctgcagccatactaaaacaacttcctttctaatttttgatacaccttgattataggtcaaaatttgaaaagtggttaaattttgtttggtattacgaaaataaattacgcattcttttgataaattgtttgcagggccgcaatatcagcacttgataacgtgctcttgccttgtgaaactgggtacatcacggattcagtcgatgaactgtgatccaaccctaacgcatgacctaactcatgaactgcgaccgatttactgaaagctgaagcgtatgagccgttaagactagccgtcgcgttattccaatattgagtaccccgccagctgatttgcttagtaatatcagggccaccatgaccaagttcaacactggtcgcaccagtcgtcatttttttatgatacatcgaaaaagtcactgaattttgtgacccgctggcttgaccagctaccagatggactaacccagtctggttataagtcgcgacagcttcaagaaagacctgccgggccgctttgggaacattatgatcgaaggaataataatacgtcttctttaaggtggcgttctgcacgatcgattcaatcggtgttgcttgcgttgttgaactagttgcttgcgaactcgaactagtgaccgaactggcactcgcagtcttatccgtctgctgacctgatgattgcttacttgagttagtcgccgaatcttcggtagcactgctagtatcatcagcacccaacaaatgactagataagtcacccgacaaggcagccgctagattctgacgactcgtctgatataaagctgccgcgcgcggggcaagcgtatcatagttgcgccacccaaataacacgaggccgattagacacagcgctttgattccgcgcattagattttttagcatgctgtgcgctcctcttaattttttaacatggtgacaagcaataatttaagtttattaaaccacatgacaccccgcttaaacatagctcttagtgaatcattaagaatatttaggattaccgcaatctacttgtaatcttaatccgctttcacacacctactcgtcattctaacaaccgcggtaccccactgaacaaaaaaagacgtgaattttcattcccgtcttgatgtggctacttatttcgaaaaacatacagtttcgagaacaagaagttcccaatgatggcgccggcctgcccaagaatcttggctagtaccgccgagctccccaatactgacatcaacaaccataaaataatcgcttcaacgacgtacgtcacgatccgggtcgcatagaacttacccatttcacgataaacgtggtgtgaatgatggtcgaacactttcaagcggtccacccagaacgcgacttgaacggcaatgacccaggaaataacattagcgacctggtattcgagtccgattaggtggtacatcgtatagaaagttgcaaagttgaccgcaacactgatcaatccccacaagatatagcgaatcgcctgattacgggtttctttaacgggtgaaatattttttttatctaattctgctgctggctctaaaatttcagtaaccgtttcctcattttgatcaactttaatcgaatctggcttactcatggttactacacctgactttcttcacttaaacatgattattgtgaaagaattctgtttaagttgtatcttcatttttatgagtaaaaataacacaacttaatcttagcacagcagttaactattggcgatggcaactattcagttttaccccaataattcacatacacaaaacgccaaccagctttaactgtccacatcagctaattctgcagctagttggcatcatcatggggccgttgcacatcaacgaataaccaaaatctgcgacaatcatgaattaaaaacggcttgccgtagccgataactcatcattatcataggtgccaaaatgatcgttgagcgtgactcgattgctgctaaatagtggtcgcagcatttaataacaccatccacaacctgaacgcctaatctgaagtctttctcgcccgattgagcggaatttcaatcgccatcacggccgccgctgtccaaataaagagatgcaagaagtcaccaactaattttccgctcacattccccgctaaatatgcaccagcatgttgatttaagaactgggttgatgggatctgactagctagttgtggccacaccaacgcgatatttaaaaccgccaacatcgtaataacccccactaattgccacgcctggcgtttagtggttgcccaatcatcaaaataattataattcataatcaacgtcgtggtcatcacaatcaacccaccattaatgaccatcgtcacgatgccgtcgttccaatgcaaaaaatagtgcaaatagcttaaaaatagtaggccaacgactaagtcataactgattgccaccaagcgctgctgccgccgattatttgccgactgagcctcgtagtgttttaacatccctaaatctcccttcaatagttgatcgactgaaaaatcatacgccatactaatttgcaccaacatgccaatatctggatagcttcgaccattctcccagcttgaaatcgtctgtcgtgaaacgtgtaattgtgtcgcgatgtcagtttgagtcatcttcttttgttgccgaataatttttaaattatctgaaaaattcattttcacacctccaagcacatcgtacgcgacgggtgattgttcggcaagataagtttctaagcaagtcgatgaagccggcgatttgcgcgtgttgtattttttgagaatcgcgaaccaaaacgctacgacaatgatttccgtcatagcgttttagtctgcttggttgactgcttagtaagttaaaaatattattatcaattagaatgttttatatcaaactgttttaattattttgtaggcatacctaaaaaaatatttccatttacttttatttattgtacaatgacaacggctcaaagatttagagatatagaaaggtggtcttttaattgagcgaaaagacgaacaccccaaaccggaagcataaattgattgaatatgctaacggcccctcactagaggaaattaacggtaccatcgaggttcccaagaatctgaacttctggaaaaccctctttgcgtattcaggtcctggtgccttagttgcggtaggttacatggatcccggtaactggtcaacttccatcaccggtggtcaaaactaccaatacatgctaatgtctgtcatcttgatatcaagtttgattgcgatgctactacaatacatggcggctaaacttggtatcgtgagtcagatggatctggcccaagcgattcgggcgcggacgagtaaatcactcggaatcgtcttgtggattttaaccgaattagccatcatggcgaccgacattgccgaagttatcggtgctgcgattgccctctatttattattcaacattccgttagtcattgcggtgtttattaccgtgcttgacgttttagttttgctattattgaccaaaatcggttttcggaaaatcgaagccatcgtggtttgtttgattttagttatcttattcgtattcgtttatcaagtcgcactgtccaaccctgattggggcggtgtgatcaagggcctagtcccaaccgctgacactttctcgacaagtcgttcagtaaacggtatgacgccactttctggtgctttagggattatcggtgccaccgtcatgccacacaatttgtacttacattcagccatctcacaaacgcggaagattgaccacaacgatgaggaagatgtcgcgcggaccgttaaattcgctgcttgggattccaatatccaactttcattcgctttcgtggttaattcactattattgattatgggcgttgccgtctttaagagtggcgctgttaaagatccttcattcttcggtctttatgaagcattgtccaatacatcaatgttaagcaatggtattttaatcagtgttgctaaatctggggcgctctcagccctcttcgccatcgcgttactggcttctgggcaaaactccacaattaccggtacgttaactgggcaagtcatcatggaagggttcgtccacatgcggatgccactctggttacggcggttagtgacccggttgatctccgttattcccgtcctcatttgcgtgctattaactagtggtaagagtgcaatcgacgagcatactgcattgaataatctgatgaataactcacaagtctttctggctttcgcccttccattctccatgttaccactattaatgatgactgacagcgcggcagaaatgggcaaacgattcaaaaactcactttggatcaaaggtttaggttggttatccgtcatcggtttgactttcttaaacttactcggtctaccagattcaatcttaggcttctttggcgataatccttcagctggcgaacagactttttctaaaattctagcctaccttttgattgccgctatcttagccctacttgtctggaccgtcttcgacctacaacgcggtaacaaacgttacgttgaacagcaacttgctgcagcagcaaaggaggccaacaaataatggcgactaaattcaaccggattctcgttggtgttgatgattctgccgatgctttacttgcttttgactatgcaatccatcaagcgaagcaagatggtgccgaactggtcattatctcgattcttgaaaatgatgaaatgaacgtctatcaagcgctcagcaaagactacattcatggggaacgccaagaacttgaacagcatatattgaaatatcaaaagcaagcccaagctgctggcgtcaccaaagtccacgcaatgattgcggaaggtgaacctggtgagaccatcgttaaggaagtcatcccccacgttcaaccggacttactcattattggctccctagccaaaaaggggattgccaaacactttggtagccaagctgcttatatggcaaaatacgcaccgatttcagttttagttattcgttaaatcaattaaaataacctcaaaacccccgttttcaatgtgaaaacgggggttttaggttaacaaaacattatttgactattaacctaaacatactataatagtcactgaagggggattcgattatgacaccaaacgaaacctacgacgcattagaacaatggcacttattaccggcgactaattttacctggcggcccttcaccgctaccgctatttatgttgacagcccgcatgcgcggcgtgtctatcagctagacttagctgacgacacggtcgaaatctttcaggccgatccaggctcagaactgtctgagcatttcttaccatataagacagttacactgaccacaactcaaatcaatcaattcaagcatacccagccagttgcatcataacggctacgggcaaagcggcgggcacccctcttagtcaatgattaagaaggcgcgcccgccgcttataatttcaattattaatgatccaaatcaactgctcgttgacgatcatggtgtatcaaccacaacaaccccactaagagcaccaagagtccaaccagcatcaacgcattcttgaagtgcgctttaatcagttcatcgccaccccaagcatagataatcgccgtgggcatgctgcccagtagcgttgctgcggctagctgccggggtgtcaccgccgtttcaatggccgctaaactaactaatgacgttggaataaacggtatcgtatacccaatcacgattcctaataaggggtgccgcatcttaccaatggccgtcacgagttttgacggctgttgatcacgtcgagccgttacccgtccgaaaaagcgttgtgcaatcaagttgcccagcgtaatgccaataatatttaacactgccccaagccctttgccgaaacagatgccagcaacgacactgatcgtcgccacgggggcacctggaataattgaaaagcaaatcaataagggaactactaataaaatatcaatcgcgcggtgccgtcgaacttgggccaccagtgctgattgatcaaatacccgatgctgaatgatctcccaagtaccatgatagcgatagatcaacagtccaattaatagtaatgctagcagtactgccccactgataagctgtcgtttcgttatcttaaccttcacaacttcctcccgtcattaatcacgatgcggttcatgtttaatttcatgagccacatgtccaatcatggcatcaaccatttccaaaatatggggatcgtctagacaatagtagacatgcttcccccgcttcgttttagataccaactgatactgaaacaaaattgctaactgatgcgagactaatggctgcgccaaatgaacatgttcaacgatttgcgtgacgtccgcttcatggtgttctaaaaaaattaggattttaatccgattaacattactcaatactttgtatattttagccgcctcagttaatagtggcccgctgacctccatgccaattcctccgttctcaccaatcataggaatgcgattaaatggctaattagcccactatcccagaaaacatataagccaatcaccacgtaacaaattttcatcaaccgttcaccatgagccgctatttgcttttgaacagccttgatttccgccacctggttaatgataagcacgacaagcatcgtcaatataccaataaatcctaaagtcatcacaaagtgtaccatgctttccccaacgagcacaggtaaaaagatcgataaattacaaccagcacatacggccaaataagtgactagtacgttaatcaccggcgacccaccagcccgatcgacagtatcatcatcatcgtcgtgaaacgcaagccaaatcggcagcacacccaagaatcctaataaccattctggcaaaaataaggtcagtgctttacccacaaagaagcttgccgttagtagaataagattgcccaacaaatagcccaacaagacctgccacaaccgatacttcttcaataaaaaaactaacatcaagaaaaaatccaaattgacactcaaaaacgttaacgctaaaaccccataatgcatcatttcacccacttttctttacgcgttgtgctagtatttagcatcaactgtgattaaaacgtgccaagtttagattgttgttcgtcagccggtgcgcgtcctaatccgacctccagggctgggtgacaattgctggaacgcagccgacgtcgatttgagctaacgcataacccgcgtcatctcaaatacgagtcttattctaagccggaagcaacccacttccagctaagaataatttggctactgagcattgtcaccagcccctccagtcgggaagccgctcgaatggctgatgaacggccactgaactcggtacaatttgtcgttggctattttgatactgaaccctttcagttaaatatcagagtgccttctccactttttcgaaatattcaattattactacggtaatttagaaatagtgagttatcacaagactttttcaatctgacagttgattgagaaaactgtcagattgaaaaacaacgacaaattcagcaaaagttgagtacatccctatcagccattcgaacgctatcccgactggaaggtgtttctgacaatgcccagtggtgaaatttcacttagcaagcgtcctgtgcttggttagtgaaaggccagtatttgagacgtggtttttcggctcaaatctgtgcccaccacgttccggcaattggcagaaatgcctggaggtcggtgtaggacgaattaactaaacaagtttacgctgagtcgaactttcccagcggtccatagctggctgcttttgaacttaaaaacttggcacgttttaatcacgattcatgacaaattggctcgcgcaatgtgtgttctatttagttgtcttcattatatgtcaatttcgacatatgtaaagcaaattagcatcaaaggccccacgcacaaaaaacggtaatgaaacccgtactggctttattaccgttttactaacagactattttagttaatgactcacaattacttaatcagcggcgagggcatcgattggattcaaccgagcggcgcgccaagctggtaagatggctgctaataaggcaatcaccagggcaatgataaaggtcgagataatattacttacctgaatctcaatcatattgtagctggcgatttggtagaggaccttattcaaggcagctccaataccataagcaattccagtagctagtagtgcactgatgaccccaatgatcaatgattcactcgtgaacaatcgccgaatatcacggcgactttcacccagcgcgcgtaagattccgatttctttcttacgggcactgaccgacatgaacatggtcacaatgatcattaacgctgagactagtagggaaattccagcgattgccgccaaaatcgtggttgctaagttaacatacgtattgaccgtatcaagcatgctggcaatactggtggcacggtaaacccgtttgccatcaatctttagcttattaatctgcttggttacagcatcattatgctcccgcgaatcaactttcaccgcaactgaagttggctgcgtacttaaattctttgctgaccgcatatctttcatagtggcgtaggtcacggcgttcacaccacttccagtcgtgctgtccgtgatcccggcaaccgttaattgccgtttaaccgtgacacttttaccactcttattcgttgtctgaaaagccacagtcactttcttaccgaccaattgcttccaattcttagatgaccatttcttcgccacactactcttatcgacgacgatttcattcttaccagccgcgtgaccagctttaataatcgactttcggttagaagccgtccacgttgttaacgatgaagcggtgtagtctttattaccaactgtaattgtcgcgttacttgcactcaaaattggctgaacggtctgaacatgcgcaacttttttcagtttactcagttgggccgtactgaacgttggctgattggtcgtcgtcacactcgctcccatggcagctgcctgctggttgccttcttggctgccgcctcgctgactttgactcgatttttgataccgactcactgtcacgacacggggattgaccatatcattgatttcctgattaatataccccttgaggccattacctaacccgttaaacaacatcactgcgaataaaccaatcgctgtcccaatgataataatcaagttccaagtccaagtatagcgtagatgtttaaacgccgtgttcagtggcacataccacggtaacttacgtgccgcaatctgttggcgattttcatcgaccggataagcgggtttcacccgctcgtcatccgtgattttaccatcagctaagcgcacgattcgagtacccgcattcgcaacatcctgcgaatgtgtcacacaaattacaagccgaccttccgccgcaatctgatccaaaattttcaaaacttccgtggtattttcagaatccaatgcgccagtcggttcatccgcgataataatctgcggatcactcgctaaagcccgggcaatcgcaactcgctgcttctggccaccagataattggttcgggtactttttaatttgatccgctaaccccacctgagttaacagttgcttagctcgttgctcacgttctgaccgatttaacttggtcatatctaacgagatcaggacattgtctaacacggacagatggttgatcaaattatatgattgataaatataaccgactgtttcacgccgatactgatccatctgtttctcttggtgatgatctaacgcggttccttgcaataacacttgtccctgaaattgccgatccaagccaccaatgatattcatcaacgttgacttaccaccgccagattcccctaaaatcgcaacgaattcacctcgttcaaaagttagattaatcccattcaagactgggaaagcttccttgcctaaataataggccttgtgaatatcttttaattctaagtagctcatcctcgctcaccctaccttactgtacgtcaatatcgtgtgccaactcccctttatttatatcaagggctttaactgtgactattagtcattaagtttaccaaaaaaacaactgtggaaaaaatcttataccttatttttattgaatcttatcatagcactttagttagactataacaacaaaaactaactattaagctaaataatttgaaattaattattagggagtgacattacaacctggttcgctctggtacttcaactgacgtcaccaccgttgatcagcgtgcacaaaaggcagtttcgagaaacacaccgttcccagaaactgcctcatccgtgcttacttccaaaattatcgtgacaagttatatttacctaggcgcgtcgcttccgccaccaaaccgcgattgcaccagtcagcatgaggaacacaccgccggcgactgctagccagcgttgcaccgcttcacctgtctgtggtaaccagccgctaccatgatgacctgtcgaatgactgccatgattagtagttgcactcgagctagtttcaggcaataccgtgccactcgtcacccgatccgtgactgtacttgcatgcgaactagctgtaccggccgtcattgaagtgccattgtcgttggtgctcgttttgtctgcacctgatgtattaactgtcccactccccgtggtgctagtttcatgcttgtcgggtttgacagcagtcccgttgccattcggtttagttgtgctactaccatttttgtccggcttaacggtagtaccattgccacctggtttagtcgtgttgctaccattttcatccggtttaacggcagtaccgttaccatctggtttagttgtcgtgctgccattttcatccggtttaacggcagtaccattgccatctggtttagttgtcgcgctaccattttcatccggtttaacggcagtaccattgccatctggtttagttgtcgtgctaccattttcatccggtttaacggcagtaccgttgccatctggtttagttgtcgtgctgccattttcatccggcttgaccgcagtaccattgccatctggtttagtcgtcgtgctgccgttttcgtcgggtttagccgtacttgtcagcggattatcattatccaaatccacaagcacttctgtaccgtcggcagtggcagccattgcttgacttaacatgatggtcttagccgcacgcgtcttacttggtaccagttcaatcgtcaccaggtcagtcacgggttggctggcactgactgttaatcttaattgaccattagcgaccgtctgccgtaaaatctgcacgccggttggaaccttaacgtcagcgacttcccgacctgctaagtccaattgcagatcaaatgccgtcagttgccggttttggttatgagtcaattgaacttttgcttcctgatcattgcgcctgagctttaacgtttcaactgaacgtttcttcttcgataggtcagtctgcttaagaaaagccgatgagtcaaagacctgactgtcaaacatctgtggtgtctgtgggacttgcaaagcattcaggatgagcgcactgatatcagcattgcttccaccatgcaaacggcggccattatcgaccgtttcgccaccgagcgccatgaaaacactgcggttatattcatcccaaccaccatgactcttgccagaaccgccatgatcagcgttggcaatgactaacgtatcatgaatgtgaccggttgcttcaagcttatccattactcgcttgaacagcgcatcatattgcgcgtacttatcccagtaattgtcattataccagccgtgaccgtgtccctgaccgtccatataatcactttgcatgtagactaacccagtactttgaaattctggcgtgccgatatagttagccacatcatcaaaggatttcagcgaagctgactgtttagtagtcaccgcggcatctggttcaatgatgctattgacgattggtccccattctgagaaagccgcagcgccccgagttggattatcggcttgtaacatcttaaatactgatgggaacattgcttgtggtttgttaaagtctgcaaagtattcttgtcccatggtcgcgttagtcccttgatattccttaggtagcgtgtcccatggccgaccatgtaacatggaaatgtagttttgtgccgaaatcgctggtgaaacggcccgcgctgacgtactcattgcaaactgcttattgaataagtccatcgtatacgtattccgacgtttcttcatgatttctgggttggttgtccatacgggagtcttagttccttgctccgcaccttgtgcatagtacattcccttcggatcccaggggttcccaccaccatcagtcgttaaaacgaccacgtgtttataaggcttgatttcagctgcattggcggctgccactttatcggctgcgtttgccagggccacgtcaccaacaccaataatcccgtcaccgttataatctagcgcgtacttaccttgaatttcaacagtttgagctggccctagttcaatggttgtatctttagttagctgctcaaacttgatctgcgtctcaccagcggccttagctttcaaattaaggtgcgctaaccgcgtttgcgcatacattttaaattcagcttttgaaaggttcgccgtcgtagtcaggcgaatacggccaggcgcaatcagttggacctgcgtctttcccccttgtaagagacgttctgcaccgacatagtcaaacttagccgcatcatacacgacatccatggtgattggggcggcaccggtagctttgatttgccgggcgtgtacattaagaccataagtgtgcccactcgcaattcgcttcgggccaacgagcttcgtcgcaatcgtttggtcgactggtacgggtgcgaccggctgcttgccgacctgtgcttcaacgttcaattgacttacttgttgcgacgtcaatgtctgatcatacaagcgggcctgtctaatttgaccggtcatcattgactgaacgtgacttccaggaaccgcatcaccacccagcacaaagtctttggttccttgtgccagctttaaatcaccgggcatagccacttgttggactaactggccatccagatacaagctagccgtcttattcttatcgatcacaccaaccgcatgcacccactgccccttatgtaaggtgcctttaggagtcttatagccggaaccatcatgggcgaagaaaacgacttgattgttttgcaccccaagtcctaaaccaccaccctgttggctagaaaagatctcatgttcaccattggcatcggcggctggatcatatttaaagtacgcctcgatcgccatcccattctgtaactttgcaaactgctgatccgtgaaggtcgtgtaaaacgctgatttgccatccaagttcaacacttggtcgttaaattcagggtccttcgtcacggcaggctgcccataggtttgccactgcgtctgcccaattaaatcaaccaattgttgattttgaattgccaaactcaaggttgctgttggaacggccgggctggcaactggttcggcaacttgctcactcggagtcgccattggggttactgcagcgacggccggggtcaccgttgttgttaagattgctgaacaaactaataaggtcgttaaaacacgcggctttatcattataaaattatcactccatcttttttatcgtaaaacaaactgcacttttaagaatagttaaggaatgtaaagtgtttagtcagatgtttgtaaagaaacgatattatttatgttgcgatactttaccagccagaaacttgtcaacgaccccaatcaaaaaagctccccacgtcttgctgggaagcctgataagctaatctattcctgtcgcactaagccgtttgttgatagccatttgcaaccagctgatttctaaaccacgtctcaaacataaaaccataccaaatatcgcctagtaacccgatactcatgacaacttggtcactaaaaaacagctgcgtcaccatatttaacgacagcatgcctaagaatggcaccgccgttttcagtaagaaaaacggggttcgacaccgcacactgaacagcgcataaaaccacgtgaacaacagggcccacacgttaaagtgcccgtacacttgcttggtactggtctcgccattgatagtcttagtaaacgtcatatcatgtctagctcgcttgttaaagccaaaccattctgatggtgcaaagttcatgaaaaccctcctcgtatcctgttcaatcattataagagttaactcactaacttaccactaactatcacgcttgcatgccaaaaaatcgtcgtacctcattagcgtaattaaacttagcgttcagtttgcccaataaggcttggtcatgggtactcgtaaaaccagtccggcgaagatgttcatataagtctaaatatggtaattgttgttcacgcgcaacggtcaactcaaggctaatatcataatcaacttttcgaaaatccacactgattcgacccgcgtcatccaccgttaagattgcatagtgagcacgctgatcagccatgaacttagcgtatggactataaggttggcctgtcgccccgggattaataatgagctggccccgctgactcacccgcataatttgttggtgggtatggccgtaaacggccacatccgcatcaccagctaggtgatcaaaattagactggcgttcatccggatacaggtcgtgaccagtcgagcgttccggctgattatgggccagttgaaaagttaacccgttcacgaccatcgttgtcgcaatgggccgttgcactaattcagcgtaatgcgatttgctcagatgggtcaccagatacgcggtcaatcgtgcaaaataaatctgtgaaggatcatccagtcgcccgtttccagtcatgaccgcattaatcccctgttcccaattaccttgcaaccatactgacggcgcagtgtccgctaaggtctggtagagcttttcggcacccgggccgggtaagaatagatcaccgaggaaccaataatccgtcgcggcttgctgacgcgcatccgccaacacagcattaagcgccgtcaagtttccatgaatatctgccagcacagcaatccggtgttgcatttctcgacacttccttttgcacataatacttctagtatacgctggcaatttacacttgtcgcatgatctctgttaagccagcttattaattggccataacaagcgcagatggtcgtcatcacaactatttgcatgtatgctaatagtaatatttagtctaattaataccttggaggaggcattcaacatgcaacaattaacaccattagccgcctattcagacttggcattcgattggtcgatcgttattaatgaaggggctgcgggactaacgaccattcgccagcatttagcagccacgcttagcgactgcctggccgcacacgtgaccatcctttgtcgacctgcgatgtttttcctgatcattcacgaccaccggcaaaaggttgcgattcccggtcatatttatcctggtacggaacaaccttatgaaatccaactagacggctggccggtaaataatagcaccgcttttatgacaattattcataagtatcactaagcacttgatactacttatctgtcgttaccacaccaatcatcgaaagtgctaatatattcagtgttaacaatgcgagcgcttccctccctatgttagaatatactaagaaccaatcaggggggaaatcaaattgcagattgataaacaacaagttggtaatcgtattcaccaacttcgaattgccgctggtttaagtatggccaaacttgcatctgcgattggcttggctggaaaaagcacaattaatgactgggaaaagggacgtacgctagctaacgcggaccgactcgctaaagtagctgcatactttgacgtatccactaattaccttttatacggtagtttgactgaatatgtcaccgctgtctttcaaaatggtggtctcaatcattcaggattcaatgtcctactatgggaatatgtggacctaactacgaccaatccgaacattctttctagtgacttgttcagttcggcctcacagactgaacagggcgtatccgacccaactaaaatcgcggcggccttaattacaccgactatcaataatgcgattcggcagattgttcctgaaatcgtccaacactaccaacaaacgacaacctacccagaacctcaagccgtcattcaggccggttgctatgtctttcgtcaccgaatacagattattcggcggacctttacgggtaaatacaaccggatcgtccgcttactagacaatgtcgatttatacgaaaagttacagccagacgatgacttaaaggcgtacttgaatcaaacaacggggcctaaaactcaagttcaaaacggttattcgttggatgaaaagtatcagcgccaaatgaacaaagttatcacggaatttcaccaagcactcaatcgcatcaatgatgcctaccaagctgaactgatggcttgtggacaaggacaggctcattctgcggcagattgaattgcttgcaaccgccaatcaaaaatcaactgaacacgaaaacacacttcaaaagtagcagctttgaagtgtgttttcgtatttaacaactgcattgcaattgctagttgaccttgcatcaatcaactatggtgacgcgatgaaattccttctgactcagctcatcgcaaacaattacacacgattagccccatcatccgtcctacttagcaacaaccgtggcaacttcttggtcgtggctcacttgtccacttgtggataaactgattttttcagcgggttgcccacctttatccacaaccaccaacaccgtcatatcctccccattttcagcggcctgctcttgatccacaaaagcgagtggtgtttctggtgtcacttggtcgccttcatgaacataagttgccggagttgcgctggtattaacacccattcgtaaccgtaccgtcagctttccagctgccagttcgatcgcattttgttctggaatcagggcactgacagttcccgttactggactgaagatatggtggcgttctggtgtcaccgcaaatcccgtctgacccgcagcgactgtggctaaatctatcagtgtgccatcaactggtgcatataatttaatttttttaccaaatgaaaatagtcccatgataaagccctcccgaatttgatgattagatttccataatggcgctggccagctaccgttctttgattacctttatcctaactgctcgaacgggtttcaggtcaagggttttatttaatttgtttgattaatagccattttgaatcagcagccgtcctttaaaattaagcactgccaaagtaacgtccacactaaatgcttctctcgcttattcgcctgcacaccctcgcagtaccgtatcgcgggccccagccaccgacaaaaaaattccccaccagcatttagccagtgaggaatcgtaacatattataacatcctgagatgcccaccaccaaaacaatctaggatttggttagtgtttgattatcactcggacaagtcccaatcatgttaaagcaaccaccgcacacgttggtgattcacgattgcattgacttccccggttaaatcctaattatctgtcgccgagtaacttttcagctgcttgtaagacattttcaccattcatcatgccatagtcggacatattgatgatatccattggaatcccagccttatcagtcttcttcttcacgtcattcgccatgtagcgaacttgtggtcctaataacaagacatcgggatgcggatcttgactcagttgatggtcaatatcagccgctgaggtggcaaagatcttgtaatcaacaccatcttgctttgccgcagcttccatcttagacactaatagtgaggttgacattcccgcagaacatgccaacataataattttttcagccataattatttaattcctttctataattacatcttttcaatttcagcgttaccagcagcagcttccgcagcggccttttcgccttcttccttcgttaagatagcatcgtacttcttagcgaatgggaagtaaattgcagttgacatgaccaacgtaattgtttgccagatagccatcttccagccaccaatcaggaaaccagaaatgattgctggggtcgtccacggtgccgcgaaaccattcaatggtggcacaatgccgaagtagatgaccagataagtggataatgccacgattactggtgtcaagaagaatggaattgccaagaatgggttcatcacgatcggtaacccgaacaagaatggttcgttaatgttgaataatgctggaataaattcaactttaccaatcgtcttaaattgcacggacttagcagcaaacaacgtaaagataacaagtccgatcgtaatcccagaaccagttaagttaatgaagttattgtagaattcattagttacaatgtgagcaccttgggcaacggtcaacttacctgctttatataatgaagcattgtcgaacgtgttcggaatcagtaacccactagtaatggcacccatgatcaacccaccatggaccccaaagaaccagaagaatggcactaagaacgcaataaccagcgcaccaccgagtgaatcggataatccttgaagcggtgtttgaagaaccttgtaaataaattgcaacatgtcagtattaccgaaagcactgaaggccgcaaagattaacattgcaacaatcaagatgaccccggcaggaatcatggcagtaaattggttggcaacactggctggtacttgttctggtagggtaatcttccaacctttacgaatcatagcggagtaagcccaaccaactaagataccgacaataatggcagcgatcatcccctgaccacctagccaggtaatattaacaaccccagtaacgggtgcttgcacaaaattttgtaggacctttggtaatttatcgatattctgtgaaacggcgctacctgacatcacgacattcccagcagcattggtaatcccagtaccggctttacccatcgcagctactaatggattggcaatgttaagcgtttgcaaaagtaagaatacggccatggaagttaacccagcgggcagtggttcatacccttcgttacgcacatacacataggcaatcccaacggccgcccaaagtgaaagaaccccaaacgttactgtataggcctggttaaagaacgctgcccaaccagaggccttaataacagcagccacagctggaattggaatattagataagatcaagaatacggacccaatgataataaatggtaaggcgtagaccatcccgtcttgtaaggctttaactggtttagtgttaacgaacttcattattggcggtaaaactttgttgttaatgaaattgctaacagcaccattactactattttccattacaattcatctccattttttgctaggaccccttgcagccaataatatgacttcttgggaacccgctttaagtcttttagatcatgattactccggttaacgtaaacaactccgtaacgtttttcgatatctgcgtgtgaacttggaatatcaatcaagccccagccgagataacctagtaccttagcgccgtcgatcaacatggcatctttcatcgccttgatatgttcttcatgataagtaatccgctcatcatcttcgatcatatgctggccatcccagtgctcgcgtaacccaatcccattttcaatcgggaacacgggtacttcgtactggtcatacaacttggtaatcaagttgcggaaaccaagtggatcaatcgcccagccccattcattagcttgtaaaaagcggttggcatcaaatgaataattgagataacgattcggaacggcatcaacgggtattttatccccgttgataaccgttgaacgataataactaaaggccaaaaaatccgctttcattttgccaatgattgcttcatcacctggttgcaaatcataatcgatgccctgttgttcaacgtaacgcaggacttctggtgaatagtgcccgtgcacgtaagcgtcattcaagttgttgttcaaaaattcgtcactcttacgagccgccataatatcaattggcttagctgtttctggataaaccggggtgtaagctaacataccaccaatcttcacgtcatcgtagttctgatgaacaaagtcatctaggcgcgcgtgcgctaacatagtatggtggaaaatccggtataagtcgttaacactttgatcacccttggtgtaccctgaaatgttgaagacttcgtcggtaaagtataaattatgttcattgaacacgatccaatatttaacccggtcagcaaaatgggcaatcatcttttcaccaaaacggacgaacgcatcaacggtgtggcgcgacatgaacccgttttcattttcagctaaggctaacggcatatcaaagtgatacaggcaaatcatcggtgtaatcccccgtgccagcatcgcatcaaccagccgatcataaaacgcaatcccagcggcattaaactcaccatcaccatctggaactactcgtgaccatgaaatctgaattcgatacatattcaaatgtaagtccttcatcaaatcaagatcttcctcgtaacgatgatattcatcaatggcatcatgccaatccgaagtggttgctgtcgcaggacgaacatcataaacagaacggcccttaccgtcttcatcccaagcaccctcagtttgcatacttgacactgaattaccccagaaaaaatccttgggcatctgtcgctccttatccatcaaactcctcctctgtgtcatttattttggaaaacgctttcctcgtgaaataatactatcctatttctatttcaaaatcaatacttttactttaaaaatatatacttttgttaaaataactaagtccggttgccactaaagtagctacaaaaagcggcctggcagtaaatactactgctagaccgttttgatcgtcctatttattcaaaacattcttaaccagtgtatcgacagcggctaataccgcagtatcagctgagcgcgcttgccaccctaacaattgctgggctttttgggtactgacctcgtgattgatgcggatcatcaaactagactcgcgtaattgcccactaaatggggctaacccccgcacaaaccagtctggaatcaaatgtttcgtcaggcctgcagccaactgcggccgttgttcttgaatcaatgttttgaggtcccgcatcgagattggtgtggcggccactgctagaaaacgctgattggccgctgcaggcgccgtcatcgcccgaacctctaagtcagcgacatcgcgaacgtcgatgacattgactttaaggtttggcatcatctggccagttaatatccgactaactagattataactacccgtgacgtgcccattaagcgatggcccaagcatggcaccggcattaaccgtcgtgaattctggactatcagcatgcgccttgcaatacgcccagccagcctcttcagcaaccaacttcgacttttcatacaacgaaagccccggttggtcttcgcgggtccagtccacttcagtgacgggatgatcatgatccaaacgactgaagccaacggcaccaaggttggcagtcatgacgacccgcttaacaccggccgccgtcgctgcctttagaacacggatcgtgccgaccttggccgcactagtgacctcatcagaagcctgaccttgattaacaaatactggtgccgcaacactcatcacatacgtcacgtcacgcattgcttcggcccaaccctgatcctgtgtcagatccagagcaacaaatgtcaatcgatctaagttaggcgtacccgctagcgtctgcttcacaccagctgctttatctaacgaccgtaacgttgcccgaaccggatagcccgctgttaataattgtttaatgatatgactggctaagaagccattaccgccagtgactaatactaatgatttattcatgtttaattcccccggaatattggttgtttttttcatcatggcttgttaatatagctaatataaaccttagacaatactctaaggcaagtgttaggaggaatctttttgacctatacgattaaagaagtcgttgataaggtcggactaagtgcgtacaccttgcgtttttatgataaacaaggcttacttccctttgtcagtcgcaatgaatccggctaccgagcatttacagacggtgatcttcatctattacatacgattatttgcctcaaaaataccggtatggcaatcagtgctattcgccaatatatcagttatgtcatggcaggtccccaatcgattgcacaacgacgagagctgctgacgactcaccgcaatgctattcttgctcagcaagcccaaatcatgaaaaatctgaaggaagtggattacaaattaaacctatatagtgatccgcacgcgcgtgaattagtgcaagaggaaattgctcaagcgaagtctgaaaaacaagccctcggtttagcagatccatttccagtgacggaataaactgttaaatagccgtgtttgaggccattttcaagcactaaaagccgattatactaaaataatcggctttttttatggctgaattttgggtgatttcacgtcataatgttaatcttaggcaaacctcaacttggttaacttagcttgtcactgtcccttatcaaacgatttaaccaacctttttcaaagtcacagttcggttacgaagattacaaaagtccgtattcttgtaatctttgcattgcgttcttaaaactcgcgacactaacaagtaacacggaggcgttagactgggttctgttgattgcgaatgacatcgcagttaagatttttgtcagtaacttatttaatcgataatcacaaaatttataggagtgtctaatttgaaaaaacttgtaagtacaatcgtaactacctcagctgcagccgctggtttattattcgccggtgtcctcaatgctaacgccgactcaacttacaccgttaagagcggtgattccgtttgggccatcgcacaaaaattcaacacaactattaatcatgttgaaacgactaataacatcaagggtcactacatcttacctggtcaaaaactatctattaagacgagttcaaccagttctgataacaacgcctcgtcaacgacttcaaacacaacgagttcaagtgcttcaacgactagttctagttcaactagcaacgcaacgaccacttcaacgagttcaactgactccacgacttcaagctacaccggtagcaatttgaagagttacgttttaagtcagatgcaatcacggactggtgtctcagcttcgacttggaacacgatcattacgcgtgaatccaactggcaaccatacgtccgcaacagttctagtggtgcctacgggttattccagaacatgcacatcagcagtggttctgttgaagaacaagttaacgctgccgttgctctatatgaagcacaaggtatggctgcttgggccctttaatctaaaactattaagacaaagtcgggattccttcccgactttttttgttgcgttaaattactttctataatcaacatccttttaaacttataagaacaataccggtattaactatttaatattgggaatgtcacgttaaacattgtaattgccgctatttttgctaactggctcaactatcggtaatttcagtaattattatattgctatttctgtcatattttttatattagtagccgatatattgtcaccgatacgtcccgtcacgatagtcttcaactattcagtaaaatatttactccccataattttctcagaatctcgcaatcgcttcttaaaattagcgacacatgcgagtaataagtcgccgctatactaatttttgttgatcaacaattgtacgacacgctgattgcttacaaaaaatgggagagtataacttgaaaaaattattaaccacaatcttaacaacatccgctgcaacggttggcctactattggccggaactgtttctgcacacgccgacgcaacttacaccgttaagaagggtgactgtgtctgggcaatttcacaagaatataagacgacgatcgaatcaatcgaaacagccaacaacattcacggccatttaattttaccaggccaacaattacggattccaggggtgaacgcccaggaccttactagtcaagcaccagcgacaccggtcgtttcagcgccagttcagcaggcaccggtcaccacaccaacccagccagctgaaacacaggccgcaactacgactcaaacaacaccagcacaaactaacgagacggttgcttcggcaccagcaactaccccggcaactgaaagctattcgggtgataacctacaaagttacgtgctcggtcaaatgcaagcacggactggtgttgacgccggaacttggaatcacatcatcaatcgtgaatctaactggcagccacacgtcgttaacggcgcaagcggtgcatacggtttattccaaaacatccatattagtggtggttccgttcaacaacaaatcgacgccgcagttaacttgtaccacgcacaaggcatgcaagcctgggccctctattaaaaagacactaaaaaaggctggaattttccagccttttttgccgttcaacgattgttaacaacgcttcaactaaccacgattaacgtgacttgtgccactcgcgacccctaattatgatccgcgtatatcaatttgccgtgttaataatcaccaacacaacttacgtcaagtgggtcaaatggtgcgcatagcccaacgcaatcacgataattcccacaatggcactcacttgatagattgggaacagtgtgggccatacccagccgatgccaaccatgccgtaactggcgattaataacaatagtccggtcagccagttgactttcttccagatcactggcgagttgtacgtccagggtacccggataccccaggtcacattctgcggaacatccatacaaattccaccaaccacactggaaagcacgccgagtgtaagcccagaattggccggctgaaaccataccggaacgactaaaattaagataagataccccaaccaccccattaccagatgatccgtcatcgctatgaagtcaaacggcgtcaacgctaagcgattggtcagccatggggccactaacaagaacagaaaagcgccggtcaagtaaaccaaccctaaccaagtaaactgttgattgcccaattgcaacggctggccgattagtgagcggccccacgcatacatgatgattaacgcgctcatcgtgccaacgatttgtaatctaactggaatcgctgttcgttttgccaattgtgccatcccccttgtattgttaacctaattatagacaggcgccagctacctaccactaatatccggtgttcaggcacatcattgccattatttaggcccctatttcgttagttatccactataattaagactaaactgattaggagaacgttcaatgaccaccatgcaattgattcatccacaatggctgttaataaaatcggggctcaaaacaattgaaatccgtttaaacgatgcgaaacgccaagccttacaagtcggtgacattgtaaatttcatcgatctgacgactgaccagcagctcaccactcagctcatcgacatcacgcgtttcgctagttttgaatccttactgagcgagtacaccgccgttcaagtcggcagtgccccgggaacgccggtaacacagatggttcaagaaatgctaacgttgtattcccccgtccaagttgcgcaattgggcgtcgtcgccttgcaggtccgtcccttaatcggacaataactggttgagctggcgatactgtgccaacatccactgttgataagtcaacttagctggcatggtttcagtcacattcaacactggcacctgattcttcttggctaatgacaccatgttagtcactaatttatcactaacttggctgttattcacaaagaaggcgacttgccgactctttaatgcctgctgcatcttgtggataacttgcggtgctgggtcagtacccttctcaatcgcattttcaaagtcttgattagcaaccttaaaccctaaactggtcaatgcgtaatcaaagacgggctcactgactaacacttgccgattctttaacttgttagccttcgctcgtaacttgttctgttcctgttgaatcggtttaagcgtggcgatgtacttgcgggcgttggccttaaaatacgtgcgatactggggttgctttttagctaactgattagcgagatagttcgcggtggcgggcatcgttgcactgtcataccagagatgctcgttagccccttccttgcgatgcatcacgtcctcgccgacccgaatcaatttggctcgttgcgtcgagcgcacgaccttgttcatccagccatcatagccgatgccattagcgatgacgagatcagcctgaccaaccgtcttagccacggttggtgttggctcaaaatcatggggatcaacggacggtttgttgataattgacgtcacgctgacgtgcttgccaccgacagcttttgccacactaccataaaaattcgtcgtcgcaacaatgttgaccttatgcgattcagcagtcgttgacttagactgacagcccgtcaacaagcccccaccaataacaagtccacctagtaatagccacaaacgtttcacaattgccactccctttttaaatagtaatcattacgttttaaagaatagcaataaatgccattcttgtaaatagtaatatttacgttttacaattttattcgttaggagtttcttatgaaaaaaattctgattccgattatcactgttcttattatcggtaccattgttggtctcagcaccctacaccgcaccccgcgagccaccacaactacggttcacaaatcacgcgttatccaacaaccacaaccgattaccgaaacgaccattgctaaacagcctgctttaaaatacagctgcattatttattacgcgatcaagcacttaaagattcagcgttggcaagaagttagtgatttcagcttgggttggcaggtcgaaatttacactgaccaggggcaaactaagtatctggtttggtctgataaacacattaaggcagatgccaagcaactccagccgaactggttcacactcaaaaatgaccatgtcacttatgacagctttggtgttcatacttttaaaaaagatctgactgccacagtcagtatgaggaccattctagctcagatcaagcgtgaccacgcgacgaaaaccgttcgccacatgccaactaaccttgtaatcaaagatcatcgttgaacacgctttaagttaacttttccattctcaggaggattggaaaagttttttttatccacgtgttttccgacccatttaccgtatttagttagtgtctactaattgatttggaaatgaggcttgtttaatgattaccaactggtttgatgatgatccactattcaatcgttactatccgtacgatgccggctaccggtattactttgaacacgaatggggtatcccggttcagcgcgatgaacaattatttgagtttctgagtcttggcggttttgccgctggtctcaactgggccgtcgtgttcaataaacgctcagcattcagcgcagcatttgacgcctggcaaattgaggtggtggcagcgtatcgcccagaacaaatcaccggtctcctcagcaattcggccatcatacgaaaccgtcgtaaaatcgaagccgtgattcacaacgctcgcctgattcaacaaattcggaccacacagtcttttaaagactatctctggcaacaattgggccatcaacaattaattatccagccccagtattatgatgaactcccacgcacaacaattactggcgatcgcatcgcacagcacttacaacaagttggttttaaatttgtcggtccgataacgattaatgcttggttggtaaacaccggttttattacggcacgtcccgaccaactgggcattattacgacgactccccggccttcgtcaacgatgctgcccccacgctcaccgcaccaactcgggcattttaagccttaacccaggcttgttgcgctgctttaattgccgttcggcgtatctagcgcgaggcccgctgattttccctgataataacggctaaaaagccaattaaagtccataatcacagtcgctatttagcagttaaagggatatacttataccggcgtcatttaattcgaaccaacgcagtttttgcgatttgaaaggtgtttgcgtatgacttggtcacattgggagataactccatttattacaagtgtttttttcatcctaggcgtgctgacccttttttgggtatcacaaaattggattatcaacttcttcaatactcatcattggcgggttgaccaatcgcttattaccgactggtacggcttaatctacatgatgttatttgtctttgggatgcaaactgccgttgtgggccagaacgacgcctggattttcatgaatttccagctcatcgggctaaccttttgtggctactttctcaatgtacgtgtccgctattactacttgtacccgcttgtctttatctttatgggcttcaatcactccttgtattactgggagtcgtgggggcacgccgtcacactgctcctcttctttacggcactcggccgattgcgtaaacacgtcccactccaaacgaaacagggacaagtcgcactttatttagtcacttgtgctggttttggggccgttctctggtggttcatgaagcttaagttcaacttatcatgggcaacttattggcaagaatggacctacctactcgtctttgcttccctgctctatatctacgccagcatgttgtcagccaatgcacacctcaaacagaatctggtcgcattcgctaatcacgacgctctgaccaaaatcgaaaattttgcagcttacaaaacagccattaattatcaggttacaagcagtcggaaaaacggctcacaattgaccatgctgatgtttgacatcgaccacttcaaacaagtcaacgacacttatggtcacttggctggcgacaaaattcttcagcacgtcgcccaaatagctacgattgtctttcatgctaataatccgcaaatctcactatatcgaaccggtggcgaggaatttaacgttatcttccccaactatgatttaaccgaagcacttgcggtcgctgaacaactatttgcggccatcaatcatatcgctgtaccagttaatgatcatcaaatccaactgtcgatctcgattggcctatcagaattagcagctgatgaccaatcaccaacggccttttatcagcgcgtcgacgccaatctatatcattctaaaaagcacggacgaatgcaaatcaccgcgaaataaaataatcattaatcttaaaaggacgattctaacgactaattttagtcattggaaccgtccttaattaagattaattcgctatagaaacgctacggatattggccatcgcaatacttgctggtgccgttagataaatccgggcttgatgccaatcgagcttcaccaactggctggttgccgtctgataatagccaacggtatcgttaaaataatcgacgttgagcaatggtagttttggtaacgctgcaatctgtttcaactgggtcgccacagctcttttatcctgagcatttggatagtgtttatgggcatagattgcagcgtgtttttcaatcaagtcatgataaccagtcaacgccgcgaacggcgcaaattgggcagcacggtctgcttggggcattggtaaatgccttgaagtaggtcgcgagcactctaaaatatccgcatagcgactcgtatcattaaataacgcagtagtaccggcttcctttgtcattaggcacgatgtcccccaatctgctcattacgttcaatcgtagttgaactcggttttagatctgccaagcgaatgacgacattcttattcccggaacgacgttgtaatttcaaaatggcgcgttgcaattgcccatcgcgttcacgtttgcgttgtgcgtctcgttcttgcgcttgggccacttctggattttcaaataagttagtttgttgataccgaggttggcgcctaacctgctgttcgtcgaccaaatggttcgccataacggtcacacgtcgaaccatcaattgacgattaacgacttgttgataaagctgttgatacgcagcccctagctcgtgttgtgaagcactcgcctgcgctaatgtcaccgtggtatgggcgggctttggtacttgtcgcccatagtagtcttcggtgaccgcaccctgataatgcgtgccaactgacgaagcattagcatcgtaatcaatacgaattcccaactgatctgtcaccacgtggcgagcaaccagttcgagtgtcaaattattcaccatgccgcgtaacacggcctgcccttcagtataagtatacggtcgcatcaacacttgactggcatatataccatgttcgctagcatggtaatttttgatgtcagcaattgttgccgactcatcgccccacgcatgatcaattaacagttccgcgtttttaccaaactcacgatataattgttcttcattatgagaatccgacaaggttcctagtgaacagcgcgcaatgtcacccatcgtattgagccccagggctgccaaccgcttagcatagccatgaccgactcgccaaaaatcagtcaacggctcgtgcgcccataagtattgccgatattgctgctcatccatctgtgcaatccgaacaccgtcagcgggaatcttcttggcaacaatatccatcgccaccttagctaagtaaagattagcaccaatcccagccgtcgccgtaatcccagtctcggcctgaatctcgtgaatcatcgtctttgccagtgcgtgcggtgaaacctgaaaagtacttaagtagtctgtgacgtccatgaagacttcatcaatcgagtacacgtgaatgtgttccggcttaatgaagcgcaaatagatatcataaatcgcagcactcttctgcatgtaataactcattcgtgggggaacgacccgataatcgatacccaaattagcatgtttgaggagctgatcacgataaattgagcgatgccgccgaaccgcctgataggaagtctggcgaccacgggcgcgatttaaagttgcgacccgttgttcaacttgaaataaccggggccgccctggaacaccaaattgctttagtgctggcgaaaccgccaaacaaatcgtcttatcagtgcgactcatatcagcgacaaccaaattggcattcaatgggtcgagttgatgagcaacgcattcgactgaggcatagaatgattttaaatcaattgccatgtatgttcgctgttccatcaatataatgactcccttccaattaatcgacacaatcgcagtcgttgttcaccttaacattttgctggtaatccaaaataaatctcatgctgctgatcgaattttaacgatagccgcatgtcgctcgcccccatgacactcacttttggatgaaacctgactcaataatttgtcgttaaaagaacatatgttcttttaactaattataaattaaaatcaggttgaatgccagtatccgttaacaaataattgcagacttcaaattagacttaagccccgaaaaggcacccgttcaccagcacgtaccgtgaccacgaacagttgcctttttaatgtcattttatgagtggctctgcgtttcagtcgggaccaacttcgtaaattcatgtaaaaaatctgccgtcttcttacccgggaacttggtgcttaatagaccatacggtactgttacggacgttttcagcggtactgtaactaaattcggatgaattcttttccacggcgtaagcgaaatcattgcgatattctcctcaacggtctcattaaacgtattgatgtcataacgcccgctagtatcaattggctgaatactaggttctgccgccaacatttcactccgaaccagatcatttttctcactaattccctttgacaccatcagaactttacgatgcgcaaggtcactgtacgtgatttcatccaactgggctaatggattatcactacggacagcaattccaaagtgatacgctcccaactgtatcgcactaaaggactgcttcaaagttgtgctatcgaacgtcccaacgattaaatcactactccgaccaagcatcgcatactcacgatttctcgaattcaagtcttcctgcaattgaactaatctaatctgaaatttaggcatctttggtgccagttctttccataatgacatgaaggcatcagcaggatgtagtaaggaagttcccaacaaaatcagttgcttatcgtctgaacggacccgtcgcgtctcttcaatggccgtgtttagtaaatcgagcaactgttgcacatacggttggaacttcttaccctgcggtgtgagttggaccccggtcgcagttcggacgaatagttttaggttaagctccgcttccagccggttgatctgtttcatcaccgcagtacccgatataaaactctgttcccccgccctcgtaaaactaccatactcactaactcgtaaaaacgtctgtaattgattaaaatccacaacggtcacctcctaaccttctagtataaactaaaagttaatgccaagctaactaacggattcttctcaggtggcacgttgctggctatactagtcattgtagttgaggcacagcacatcagaaacgagatgattaattgaacaaaaagtttatgcaaactatttttcaaattattgttaccgtcgctgcacttgtcgtcatcgtctatgcagttcagcaacactcaccaaccaccgacaagtctaaccaagccaccaagcaacagacaagcgttacctattcggacaactcgcatctgaccgaagcggatgtcgttggtgtttggatcaatcaccacaacaaagatattcaccaacaaatcactttcaccgcggatcacaagtggaaggagaaccaacatcacgtcactaatatttattccggtacttggaaagttattgggcacaatcaaatttcactatcaccctatggtgaaaaaatccagctttccggtcatgatttttccacaatggacgtcttaaattaccatcacattttaaataaacaaaaaaattaatcaggaggaaacaaatatgtcagtaaaaaacaaagttatcgttattacaggagcctcatcgggtattggcgaagccagtgccaaattgttagccagccatggtgccaaagttgttttaggtgcacggcgtgaacaacgcctacagaaattagccaataaaatccagcaacaaggtgggcaagccacttaccgcgtaacggacgtgactaagcctgaagacttaacagcgttagttgctttagccaagcgagaatttggcggtattgatgtcattttcaataatgccggtatcatgttgacttcaccaatcagtgcactaaaaactgatgaatggaatgccatgatcgatgtgaacttaaaaggtgttttgaacggtgtcgccgcagtaatgcctgatttcaccaatcaaaagtatggtcaaatcattacgacatcttcagtagctgggcttaagagtttcgctggttccggcatctatggtgcaactaaatttgcagtacgcaacttaatggaagtaatccgcatggaaagtgctcaagaacacaccaatattcggaccaccagcctctatccggcagctatcaacactgaattattgcacaccattaccgataccaatgctaagcaaggtatgaataaattatatgcatccgtcggtatcaccccagatgcagtggcccgtgtcgttgacttcgcagttgcacaaccagatgacgtcaacgtcaatgaatttaccatttacccgacaaagcaaggctaatcgatgacgacaatccacgatcaatattagaaagaagcgattcatgaatggaacggtctatcaataaagcgacgatttatcacagtctagttttaagcctaataatcattcagttactaagcttaattgtccccgtcaacttgacgctattaaatgccgtgcttgcaatcggggtctcaattctcggaattcaaagcttaagccgctcttttcaagtcgcgacattgatctttttcattgctgggttgggactgctaagtactacgggtttatcaatcaacggtctagccatggcaatcacttcaatggtcgatatcgtggtgttactagttgttatgcaacttttcttaatccctgtcaccattggcaactaccaagctactgtcgaagcattcatgcaaaagcacattcgtggccccaaacaaaccttcaccttcgtcatgattgtcacgcacctactatcaagtattctctccatggggaccgttgccattgtcctatcaattctaggcgacagtatcaagcgccaagtcaaagacgccacccgtttttcggcaacagccgtaacccgtggatttacgctcggcacattatgggcacctggagcagcaacaatctttctaatcagtaccgttactaaagtcgggtggacccaattattcataccatgcctgattttaggcctgttaggattattgctagcgtatttgatggaatataaccaaccgtatatgcggattcagcccgtgacaaccaatactaagcagcagactcgttttaccgaacacgcatcacttgtcagtttagtggcggccgttattgccctactaatactcagctttgttttaatggaaagcaaagtcgtaagttcaatgaacgctgttacactttccggtttactaattgtcctgatttgggtcacggcattagggctcaagccgactacgggccaaacagccttcaaatttgcactaaaaaaagctagccttgattattggcaacacggaattgcaagcggtgcagcgcttgcgccgttctttgttggaatcggcacgttcacgtacggttttcaacattccactatcagtagcgaactaacccacgcgttagcaccaagctttgctcaccttggctggttattggtcgttttaattcccattattgtcgtattggtttccctaattggcattcacccacttgcatcagtagcactaattggcaagattattatgaccatgcacattgccctttcaccactattaatcgcattgagtctgaatatcggaagcgtcgttgcatacatgttatcaccgtttgcaggtatcgtcatgattgtcgcgaccctgttacatgtcaactcagcaactgtctcggtacgttggaattggcaatttttcctcatcttcctcgtacttagtttgagcgtagcaactttattaagtcttattttttaaaagagaggttcttacaatgaaaaaagttattttattaggtgctaccagtaacatttcaaaatatttaattccacgcctacttgtcaaaaacgatgttgaactcacactttttgctcgtcaagctactcgacggcttcatcagtacgccgcccaatcgcaggttaccctcacgaacggcaattggaataattccgctgatcttacggcggcaatcgcgggtcaggatatcgtttacttggcaacggggcatttcaccaccgccaatcaaaatgttgtcgatgcgatgaagcaaaatggtgtcgagcgcctaattgtcgcaggtggtttaggcatttacgatgaagtcgctggtaaatttggtatttggaatgcccaaatgatgggtgattatactgaaatcaagcgagctgctgccgtgattgataatagtggactaaactatacatttttaagaatggcctggctatataataatgaccagcatacggactacaaggtcattcctcaggggatgccattcaaagatacgcaggtgacacgccaagccgttgctgacctgattactgaaattgttcacaatccccaattatatcagcgaagtagcattggcgtcgctgaacccaatactgcttggaacaaacctggtttttactaggaggtcggtttaatgcaaattaaagttgatttagacgatggctttttaccactaatctataccagtaacgcgaacgtcaaacactcaggccaaccgattctatcgtttccaattgaaatcaaatcaattcctgcaataacgactgcgtttgctatttcgctcattgattacgacgccgtcccacgaacgggttttccgttcattcactggctcgcgaccaatattcctgtcatggcagaaatcccagccgatttcagtcgtaattttgagggcccccaaggtcaaaactcatggatgtcacgcttttatcagttaaacgattcgtatttcgccgatcactatgccggaccgaatccacctgatcagcctcatcgatatacactatccgtatttgcactcaagcacaacttgccgttgaataaccgcttctattacaacgacttccgtgaacaactagtgggaaacgtactaacaaaagccgagcttcaaattttagcccacaattaattttaaatgaaaggtgtttttaacaatgaacaataatgaaaatagcgtccaacacggcatttttgcaatgggagatttaaacgttgcttttcaacaatactttaccggtaaaagttaccacaacgctctagtgaaagacgagcaagtcaacgtaactgtcagcaacgtcagctttgaacccggagcccgtaacaactggcatatccatcacaatggctatcaaatcttattagtcactggtggcgaaggctggtaccaagaagccgggcaaccggcacagcgattacatcctggtgatgtggtgatcacccatgacggtatcaaacactggcacggtgccactaaagatagttggttcagtcacattgccatcactgcaggcacaccagaatggctatcacccgttagtaatgacgaatataacgcattggcttaggaggtactagataatgaagaaaatgaagataacagccaacgaccgccacttcacagcaaatttggaagaaaatgccaccaccgcagcgttactttcacaactaccactaacactgccgatgctcaacctttataaccgtgaattgacgtatcgttttcagcaggcactccctgctaacgaggcacacactactggctatgcagttggtgatatcgcctactggacaccgcgacacagcttagtgattttttatgagcaaactggcgaagtgattagtaaccttcaaaaaattggtcacattaatgctggcgatttgaaacaattccgttcatcaagaaatattaaaatgcagtttgaagaagattaattaaggagagaaagtcatgttcaattttacagataaagtcgttattgttacaggtgcacgcacgggaatcggcctgagtgctgccactctattcgccaaagcaggtgctcacgtcattttagctggccatcatgaacctaaagacgaagcccaacagctagtcgatcatggctactcagccgtttcattcaagtgtaacgtcgctgatcccaaagacgtcgccggaatggtgaaattcgcagttgctcagtttgggcacctcgactatgcttataacgatgctgggattcaaagtccagtcaccgataccgccgatctatcggttgaagaatatgatcatgtcatggatactaacttaaaaggcatgtttctcagtatgaagtacgaattacgacagatgcgtgctcagggaacaccagccgcaatcgtaaactgttcttcaatgggtggtctcgttggtattgctgatcgaactgcctaccacgcttcaaagcacggcgtcttaggcctgacaaagagtagcgccttagaatacgctgaccggaatgttcggatcaacgccgtgtgtccaggaatcattgatacaccaatggttgcccgaatggatgatactgaacgacaggagatggacgacctagtccgcgaaattcccatggggcgtttagctaaaccagaagaagtcgctcaagtcgtactctttctttgcagtgatgctgccagttacatggttggtcaagccgtcgctgttgacggtggttacactattcactaatacgaggaggattagaatgaccaaggttttaattttaggggctaacggtcgaattgcgcggattgtggaacaacgactcttagccgaaactgacgtccagttgacactagtcttaagaaatgcagggcgcctactagtcacttcaccagaacgagaaacggttattcaaggtgatgtcagtgattcacagctactagacactgttatgcctaatcaggatatcgtctatgcaaatctagccgggaatatggcattattggcacagaccattatcacgtcaatgaatcgcaatcatgtgccccatcttatttgggtcacaggatccggactctaccacgaaacccctaatccatttggcgcttgggtcgaacaggtagtcggtcacgctgctaaaaacgatacgcgacatgcggccagaataattgaatcatcggatattcctgctacaattattcgtgcggcctatatgaccgacgataccaaaattgactatgaactgacttacaaaggtgaacgcttcaaaggaaccatgatttcacgcgctagtattgctgatttaatcatgaagattattgctgagccaacagcatacgaaaataccagccttggtattgctcaaccgggcactgataacatgttgccacaagtcaaattgatggctcagcatcgctaaatgtgaacatttaaaagtaatcaattacacctaacccgcttcaacaatcatccataattaataaaactggctgctagacactttaaaccgtgtctagcagccagttttatctgattcaattattattaatatactcagccaccgtttcaaaacaacgtggcacttattgccctgccgtactttcctgctccaacttaatcgtcaacaattccgggtcttcattgactaacgcttgtagacgtgaaaatagcatcagcaaccagccaaacgaaatcgcaaaggcttgaatctcaaatgccgtcagcgatggatacccaaaccagcgaaaaccaaagttgagtagtaatagcaccacgccaacgccgtatgagagccacagaaaatctttcgtcacggctggtaatagccaccgcacccccacaatcaacaagactaacaacgtgaccaagccaccagcaactaagtcatgtaaccagtgaaacgtcaggttgttaggaaatagcccgaccgccccgaaatcgacagcggtcaacgtcaacaatatccgcaaggttgacgttcgccaagtacgcggataaattcgactaagtgaaacaaatagatagtcaatcagaacgaccatcaataacgccgaaaaaatcagtgtcaagttgaattgccaggcattttcagcggcatgcgtccctaaaaagcttaaattatgctgccaccatcgccgttgaccattggcggccattgagataacacagccactgacaatcaccaccgttaaaatcgttgataacgaccgcgcatttatcgtcaacgcagcgctaatcatgaacgcatccgcaaaatacgtaaacaagaccagtagcaacatagatgtaaagcgatcgaagatgacatctggaaataataattctaatacccagaaagccccgaccagcgcaaaggctaagatcataataaacgcaatcgtaataactggaaagttccgccaataaatatggcgcgaaaatcgattttctggatcattacgcgtttttaagaaaaagccgacaaatagcactgcgccggtaaccacaccggccacaatcgtcaaactcccgattgattgcgcacctgtcagtggaactggtcgcactttttgaaaccaccagtacccgtaactggctaaccccgataggattgcaaccaacagcggccagattatcaagtattgctgccactgtggttgacgtggcttaatcttctctaagactagtgcgtcattgcgcacctttaactgtaactgatcatcgcgatcaatcccggctcgttttaatgctgagactgggattgaaacccgcacttgttgctcttgccctgccatgtccgactccttatactttcattactcaaagaccatctgattacgatacagttccgcatagaagccgtttgccgctaataaatcatggtggttcccctgttcaataatttgaccatccttcaatacaacgattttatcggcattcaggattgttttcaagcggtgagcaatgacaaagctggttcgcccttggatgacgttgtccattgcggcttgaatattggcttccgtcaccgtatcaacgttcgaagtcgcttcatccaaaatcagcaacttgggatttgttaaaatcgtccgggcaattgacatcaactgcttttgaccagcagaaaaaatactctgttcgtcggaaacgcgcgtctgatagccatctggcaggctcatcacaaagtcatgaatattagcctgcttcgccgcatcgataacccgatccatactagccgttgggtccccgtaacgaatattatccgcaatcgtgcccgtaaacaactggggttcctgtaagacaatcccgacattttgccgtagcacctggagatcaaagtcttgaatattcaccccatcaaacgtaatcgcaccactatcaacatcatagaagcgattcaacaaattcatgaccgtcgttttccccgaaccagttgggccaacgagtgccaccatctcaccgcggtgcacatggatcgacacgccatgcaagatttctttacctggtaagtaactaaagcgcacattatcaatcagtaattcatcatgaatcccgtcgagcgctttaccgttagcggggctcacttcatccggttgattacggacttcatcgacccgccgtgcaccagtaatcgctaactgaatcatactatataaactagtcaatgacataattggctggtagtactgttgggcgtagttaacgaacaccacgaccagcgccaaagctgctccagtcgacatactcccattcagcgctaaccatgagccaaagaagatgacaattgccgtgttaagcagtgacatcccttgcatcagtggattcaaaatacctgaccagatttgacccgtcaacgctgactggcgaaccttaccattatactgatgaaagcctttcaaggagtcctgctgtaagccgttggtaatcaagactttttgaccggtaatttgttcattgatataaccattcagttgaccgatatcatcctgttgttggttcaccgcgacgccagccttgtgcatgacaaacgccgcgataattaatgcaaccggcgtagaagccatcgtcacccacgccatcgtagtgttttgattaaacatcacaattagcaggccaacaaactgagccacggctaataaaatttctagcaaggcttgattcatggcattaaaaatattatctaggtcagaggtgaaccgagccagaatatccccgtcactatgcgtatcaaaatattgaaccttcatccgttgcatcttccgaaataggcccacccgcattgtcccggtcgaaaaggccgtcacgcgtgctaagatcaagctcgcaataaaaatcgtgctagcatcaccgacatacaacaagacgtagatgatcagggtccggttgaacggttgcaaacttgcttgtgcccgagtcgcttgattcgtccactgctgcaagtactgcgtcagctcctccacggctcgtcccagataagtcggtgcgaccacaatgcaccaagtcgaaaaggcaatcagaatcacacttagtaagaagcctaaccagtagcgttttaaatagtgccagtaatatttaccagcattgcgtaaatcactcatgtaagccctcctcccgtgctttttgcgtttggtaaatagcgcgataaatcgcactatcttgaagcaattcgtggtgagtcccctggcccgaaatgcgaccattatctaacactaagatttgatccgcacgaataattgaagcaattttttcggcaatgaccacggtcgtcgttgacttcaactcgcgatccaaagcttcttgaacaagtttttctgaacgcgcatcgagtgccgaagtcgcatcatctaaaatcaagatttctggattggcaattacgccacgcgtaatcgctagtcgctgcttctgaccacccgaaaagttctgtgaccgttcttccacgggggcatcgtacgtctgtggcaaccgttcaatgaattccgcagactgcgcaatattagccgcccattgcatgtgactaggctgggcgtccggcttaacttgccgtaagttacccgcaatcgtgccagaaaatagcgtggaccgttgtaagacataggccaccgtggatcgaagggctttttctggtaaggcccgcacatcaattccaccgatggagaccgttccactatccggatcatacaagcgcgcaatcagctgggccaacgtcgtcttaccagatccagtggccccaacgattcccagcatggaccctgcttttaccgtaaaggtcacgtcttttagcgttggttgcgcatctcccggataagtgaaggttacgtggtcaaagtgaatatcaccagctacgggcgccgcgtcgccatcaacgtaggtcatacttggttcggtagtcatcacttcgccgattcgaccaagtgagatgacggcccgcgacgcaaaagtcatgagaaatcccccgttgatcacggcaaataaaatctgcattaaataagaaataaaactcgtaatagctgctaaataggccgggtgcgtcgtaatcgtttgaccgaccaagtaaacggcgaccccgaccgccacgttggccgtcaaaaagaacgctggcattagaatagcgaaccagtacccaattttagcggtcacagcggttaattcatcggatgcggccgaaaactttttgatctcgtttggttcttgaacaaacgatttaacaacccgaatccccattaagttttcgcgggcaaccgtattgacgttttcaatatcttgttgcgtttgtgcaaagtatttagtcattcgccgcaccgcaatcagtgcgacccctaagattaccgccatcatgacaacaatgacccaccactgctcaggcatcgtcatcacagcgagaatcagtgccccgatgaatagtaatggaatccgggtaatctgctgaaagccagccatcacaatctgttggacttgattaatatcgttcgtcattcgtaccactaagttggacggtgaaaatttttccacgtcagcgtaggctaatgactggaccttagcgtataggtcagctcgcaagtcggtcgccacaccaagggccacctgggctgcgtatatcgtattcacgatcccaccaatgattcccagtacggccaaaccaagcaacatcagcccttcacggaataccgtagcctgatcattcttgataatggcttccataatgacttgcaataatcgcggttgccataacgtcgcaaacactaagacgatgaccgacagcatcgcaatccagacgtctagtcgataccgcttaaaatatggcatcaaaatcttcatcaatcgttcctcctcataattgtggtctccctgtttagggtacctgaaattaacagtcaggacaatcaatatatcatatcttttgcaaaatcagattacgatgataataattcagtatatgtgcgagaaataatgaatacgatgttcggttatatcccacctaataacgtcattcagttatcgcagactttataataagaattaatattaaataaggggtcccaacttctagtaataatcaatgttcctaatacacctcacgccccataatttattgatctaactcattgcgtgattgccactaatcttcttatttgatgatacactaacgatagcacctgactaacaatcagaaaggaagattctaatgacccttcaagcacaactcatgcaacaactcacggcggcggaaccggaaatgatcaagattcgtcgccacttacacgcccaccccgagatttcatttcatgaagaacaaactgcagcttacatcaaagcgttctatcgtgaactgggcgtctcaaccaccgcttatggtgatgggtacggcttcgtcgtcgacatcgatagcggtcaacctggacctcaattagcattacgcgctgattttgacgccctcgcgattcaagaagacaaccacttatcatttaaatcgcaaaacgccaatgtcatgcacgcctgtgggcacgatggtcatactgcttatctcatggtactggcgaagaccttactcgggctgaaaaatcagctacgtggtcgcgtccgcattatccaccaacccgctgaagaagtgtcaccgggtggtgctaagggtatgttggctgctggtgtcctagacggcatcgataacgtcattgggctgcatgtgatgagtaccatgccgacgggctcgattgcctatcacttaaatgcgacgcagaccgggcgggctaattttacggtcaccttcacgggtaagggtgggcacgcctcgatgccccacctctcaaacgatgcaatcgttgctggaagttactttgtgaccgccttacaaaccgttgtttcacgccggattaacccatttgataccggcagtgtcaccatcggctcattcgacggcgtcggttccttcaatgcgatcaaagcgcaagtcactctcaagggcgatgtacggattatggacgaaaccacgcgccagaccatccgtgaccagattactaaaattgcgaacggcgtcggggcgactttcggtgtccaagttgcacttgattacgatgataattatccagtactcatgaatgatgcaaccctgacacagcgcgtcatcactagtattcaagccgctcagattccagaaatcactaaaattttcgactgtggcccccaagacccctcggaggacttcgcctattttgcacaagccaaacccagcacctttatctatgccggctgtcaaacagctccgggcgagacccacccgcaccacagccctgattttatgatgaatgaagactgtttactaattgcggccaaagcggtgggaacggcagcgttggactacttaatgaacgcctcatcagatcattaaacacactaaagtggctaccttgaatacatccatccaaggtagccacttatgatttattcaagccaatcaggaattaacttacagtgagtacctaattaatcacgccgccaccagtcacgccataaatttgcgcggtcacatagctcgcgtcgttagaagctaaaaagacgtacactggtgctagttctgcgggttgtcccgctcgtttaagcaaggtatcttggccaaacttcggcagcgcctcgattggttggccttgatctaattgtaggggcgtccagattggcccgggagcaacgccattgacccgaatccccttttcggccgcttcggctgctaaattaatcgtaaagttcttgatggccgccttagtcgcagcataatctaatagatgaccactcggcgcataggcttgaatcgaagtcgtggtgacgatgctactgccagcgggcatctttggcaaggccgcctgagctaacgcaaacatcgcgacgatattcacttcgaaggtcgcacgcacctgttcgatcggcagcttagccagtgaaggttgtgaaatctgttgtcccgcatttaggacaagggtgtcgataccaccaaattcagcgattgtccggtccacgaggtcggtcacaacgtcaacatccttgaaatcacaaggtaataataacgcttgacggcccgcagcgcgcactagttcggcaaccgcctcagcatccggctcctctcccggcaagtactgaatcgcaacatcagcaccttcccgcgcaaaagcaatcgcggtagcccggccaattcccgaatcaccacccgtgatcaaaacgcgtcgattcaacaacttatcatgtccttggtaactcttctcaccacaatcaggttcaggacgcatcttagcttgtagtgcgggtgtctcctgatcctgcttatcaaagccatctgtcttatataaatagcgtgggtcacgtaattctggttgtttcatgagatttcctccttcaaaagaatacccatagaataccggaattagttttcggatgatagttaaacgcacactaaataataatagttacgattagatattaggcataaaagctgtcatcgtcttaactcacttaaattgacgctgcttcaaaaaacgataggcaattattccaacaacgccgaccaaagtggcccgtaataaccaactgacagaccaccacgtcactaacacttttattaacgtcatcccatcattaatcgtcattcggctgttcctccgctaatgttgccaattgacccaacttccgctgaaagtcccgttgcatgacgggcttcactagtggcaacggcagccagctcggcggtgtggtcgtaagggagacctcttcctggaccgcagttcgctcggccaatggcgtcatggtgaacacaatttcatatcccaattggccctcctcactgtgataaacgacctggtcagcgccgactgtaacctgcaactgttccggctgatcaaaagccgaaccggaccgctgtaacacgtaccccgtcgcggttggcttgaccgtggtaatggcagtcgcccatgctggtaagttcagcggatctgctagcaatgctcgcaccgttgctggagttgcctgtgttaatacttgattcgtaaataatgctgttgtcattttataacccccaatgttcatcctaacctggtcatcgttattacggccaaccactccaaatcaataacggaccgttaaatcaagtgcacatgtatttagttggtgattataaaatacacggtggggacgccaacataaaatcagaatactgataatttacaggcggtcgttaatttgttctttaaacaggtctttgaaaacttgtgaccgttggctggcaacctgcgccgtggcagtctcccccgccgccattgcgagttgcgccatcaactgataaatattggccagcatgtagtgtgaatcgtgtgtagtcgcaaaggccaacccctgcgtcaaacgggccaccgccaactgggaatcatgttgttcataggccaccaacccagcaaggtaaaaaccaatgttggcattttcttcatatgcactcgcatcaatgtcagcgagtgcccgggtgactaaggccgcgactggggcttgaggatggtggtgcgccttaacgacggctaacgaaatcaaggccaagcgtgtcaacgttgtcggcggcgagctgggagcagccataccaattgccagccgtaaattttgttgtgcagcatccgatgtgcgatcaacctgccaacaggcgacacccagataataatagtaagcctgagtctgctcatccgtttgaacatgttccaaagtggttggctgtaatagccaatccttcaattgctgatactgatgggcattgcacatctgccgaacgcggtcattaaacgcttgctcggcactgatctcaaaatcgtcggctaggctcaacgtactaaccgcgacccctaatcgctgacacagcgccagtaatagccgggcattcggcacgtagcgatcattttcaattgctgacagcatcgattgtgcacaaattccccgggcagcttgcttttgattgagttgcttggctttgcgtgcctgctttaacgcagttcccaatgtcatgaccattcccccctagatagcttttgctaatgagtgtactaaatttcccatattaaggcacttaaaaaataccattcaatgctgttttatcagtcagcaatcgaatggtattttgaaattggttatttaattgacatgccgttctcgaacttgataccaaataatcccggccacaccgaagacaattggtccaactagcatccaaatcgtattttgaatctgcccagtttccaagattggctggatcaacgtgaaaacattcgcacctaagacgacaatgaacacgacccaactaataattttcgtccaagtcaatgacttgtacacttcaaaaggcttaacaatgttctggttttccttaaacttcggaaacgcgtatagcaagaagaggtatggtaacgtcatcgaaacgttcgccatcaaggtcaacacattgtaaaaggctgacgcgtctgccgttgcaaaggacgccaccaaaatgatcacaatcacgatggcacattgaaccatcatggcataacttggcataccagctttgttgagcttcgtaaatttcttcggccacagttccttaggtgttcccaagataagcgtcttcaatggtgaataagttaaggtgaagaaggccccactgtaagcgaggaacatccctaagccggtgtaccgtgcaaaccacagtcccattgtcttagcggccgctgtactcaaaccaagcgcttgccctaaaacatagcccaagttttgcatcatgacgtaactaatattaccgaggttagtcgttggattcgacaaaacggcttgccagttcgtactaatcccccagcagaagattcccaggccatagcctaaggtaataacgatggcagaaataataattccgcgtgggaaggtcttttcggggttcttggtcttatcaaccatcccaccgagaacttctagcccaccgtaagcaaaaatggcgaaaacggcaaacccgagtaacccgactggatgctgataacttggatttggtgacgtcatcacatgttgtaacggttgtgcgaattgtccgtgattcaaggctaaaacgacccccgaaaccactaacaggattgcagtcaaactggtcaccgccaggccgcctaaactcgtgacccgcacaatgcctttcatccctttgatggaaacgaacgtcactagcaccatccatagacaggacaaaatcccaatcatctgcgtcgcattcagatcaaacatcgcaaagcgctgcgtttgatcgctcccaaagaagatggtcgtaaacggaatccagactttagctgacgttgagactaaccaaataatgtacgacgcaaaccacatgaacgtgcccacgaacgcaaatttcgcattcacactcacttccagccacttgtacatcccgctactatcagacttaaccgctgccccgaactccgccatcattagcgcgaacgggatgaagaacagtacggctgcgactaggtaaaatagaatcgagctgtaacccattaaataataggccaccgtactattggcaaatccgaaaacggtcgtaaagatcatcatgactagcgccatcaatgtaatcttttcattatcttttgttgccattattgcactccctcacttactcctttaatacttttgtaaagctattccaatttaagattaccgaacgaaggcaataaagcgctttagttttcctaacaatattatgattttttcatgtgatagtcagcgcaattattcatctaaacaattgccgcaacagttattgacaaaaactatttcataacggaaacgttcatttaataacatagtaacttttctttaacatagctgacacataattggcgtattctacacttatcagcttagggaaaatataaaacggggttatacatatcatgaaaaaatttaactttaaaaccatgttgctattagttttggctagttgtgtcttcggggtcgtcgttaacgtgactactagtcttggaccacaaaccacaatcaccgcccaggcctccaagaagcttagccaagcccagcaaattgccaagatcaacgccaagctttcgaaagccaaccgcgctgccaaaaattggatcgcctatcgtgaatctggatacagttatacggctcgtaatggccgctgctacggtcgctatcaattgttgcgctcatacttacacggcaacttgtcacccgtcaatcaggaaaaacgtgctaatacctacgtcgcctcgcgctacggctcctgggtcaaggccaaacggttctggcaacatcatcactggtactaacccaatttttctattggatcacactaaaaagacgactaattactaagattgtgaatctttgtaattagtcgtctttttgtaggcagtaatatcaaatagcatgaggactatatttcaccgtcatttaacacttggttacaacaggtgtgccgtgatcgccgcaccttttctaaacgatattgtgaaaaacataattaattagtcaaaaagtattgcaaattgtaattattacgactataatttgattcgtaaattagtaatgatatcgattacaatataaaaagaggttattaatatgactgaacgtaattttgatttcttaatgcctagcgttaactttttcggtcctggtgtcattagtaaaatcggcgagcgtgccaaaactcttggtatgcacaaaccagtcatcgtcaccgacaaatttcttgaaagtctgccagacggcgccgttgctcaggtgcggcggtcactggatgctgccgggattgactacgtaatttataatcaagttgaacccaaccctaaaattcataacattcaagctgttaaagccttatatcaagccaatcaagcggactccctgattaccattggcggcggttcttcccacgataccggaaaaggtgccggcatcatcatgactaacggcgacgacatcactaagttagcggggattgaaacgctcaagaacgccctaccaccactgattgcggtcaacactaccgctgggactggttctgaattgacccgtcactgtgtcattacgaatgaagaaacgcattataagttcgtcgttgcttcatggcgtaacatgccactcgtgtcctttaacgatcccactctcatgctagaagttcctaagggactcacggccgcaactggcatggatgcctttgtccaggctatcgaaccctttgtttctgtcgatcacaatccgattaccgattcacagtgcatccaggccatcaaattaatcgaaacatcattacgtgaagccgtcgccaatgggcataacctagaagcccgaacacacatggtcgaagctgaaatgttagccggcatggcctttaacaacgccaatctaggttacgtgcacgccatggcccaccagctcggcggccaatatgacgcaccccacggcgtctgctgcgcgctgctcttaccctacgttgaagaatataatctaatcgcgtgccccgaacgtttcgccgagctcgccaaaattatgggcgaaaacactgatggcttatcgactcgtgatgctgccgaattagctatcaaagcgatgaaacaactcagcaaagatgttggtattccgcattccatcaaggaaattggcgccaagattgaggacttcgaacacatggcgactaatgcgcttaaagacggtaacgccttctctaacccacgcaaaggtactaaagaagacatcatcaagattttccaagccgcatatgatgccaagtaatcccccattcaatgttaactaaatcattcacagcaaataatcggttcaagaattcatagtaaattcttgaaccgattatttgattgggacctctctacaactcgaatcgttactcggcaatgccatgcaccccacgtttggacgcgctattcaaaataaacaccgcaacaataaaccgacaaacacagataagactgtctatcagaacacgcattgtgcaaattaatttgtcctgatttgtgattaaaacgtgccgattaggtagattcctgttcgtcagccggtgcgcgtcctattccgacctacggggctgggtgacaattgctggaacgcagccgacgtcgatttgagctaacgcccaacccgcgtcatctcaaatacgagtcttattctaagccggaagcagaccacttccgactaagaataatttggctactgagcattgtcacccagcccctccggtctcaagagtgtgaggggccacgagttgaagccgagcattgcctagccaacggattaatgcggttttggcattagtccgttggcgtagcaagcacaggctttagtggccccgaacacgtttcgggaagccgcccgaatggctaatgaacgaccaccgaactcggtacaatttgtcgttggctattttgatactggaactttaaacaaagcgttaggtgtattaagcactctgtcaagagcttaaatcttactacaccaattcagattagtgagctatctcaatatcattttcagtctgacaactgattgacaaaattatggtttatgaaaaacaatgacgaattcgccaaaagttgggtacgcacatgtccgccattcgaacactgtcccgactggaaggcgtttcggccaatgcccagtggtgaaatttcacttagcaagcgtccttggcttggttagtgaaaggccagtatttgagacgtgggcttcggcttaaatctgtgcccaccacgttccggcaattggcagaaatgcctggaggtcggtgtaggacgaactaactaaacaagtttacgctgagtcgaactttttcccagcggtccatagctggctgtttttgaatttaagaaccggcacgttttaatcacaaattatgcaagccgtccaagcggcttgtgtttaacgcaaaaaacagcgatgtcaaaatcaacttttgacatcgctgttttagaagttattcatcataactgatggcacccagccggcagctatttccccggttgataatcttcatcaatgatcaagacaggtttgatggtcttgccgctacctgaatcagcattagcttgattaatatcctcaaacttatagaacttttcggtcttttcaaatgggaacatgccatgttgatagaaatcgattaaccgtggaatatcaacgccagggatggcatcacccatgttaacaccaatgactttcttatcatcaacacacaaatcgttccatgagctaatggtgatatttttggccgtaacggcaatcaaagcagcagtcccaccttgagcaagtgcgtggattgcagaaaccataactggttctaccccagtcgtatcaacggcaaagtcgaccccgtacccatgcgtcaacttcttgattgcttcaactggatcttcttccttactgttaatggcatgagtagcacctaattctttggcgagttctagccgtgaatcaacaatgtcgaccgcaatcacttcggtacagccggaaatcttaccagccatcattgccgctaaaccaaccgcaccagtcccaaagactgcaattgtttgtcctgggcgcggctgtaaactgttcaaaacagtgccacttccggtgacatagccgcagcctaaaggtcccaagcgacgtaaatctagttcttttggtactttaaccgcattacgttggtcaactaccgtatgagtcgtgaaggaagattggtcgaacatatcactgatatggtgcccgttttcttggaaatggtcggaaccatcgggacgagtcccactcaagttatagtcggcataattccgacatttagttggcatgcctttcagacagttatcacatgttccgtcagcgtaaaatgatagaataacatggtcgcccacttcaaaattagttacttctgaaccgaccttttcgacgattccagaaccttcgtgtcctaaaattactggataacctaacgacgcatcaccccgccgaattgcttcatcagaatggcaaattccagtcgcaaccattttgatttgtaaatcagttgctttcatttcagctaattcaatatcatctttaatgacaaatggatcgtttactttatcaaccactgctgctttaattttcatgttcaaaccctcgtttcaaatagtatgtaaaccgcttacaattaatattgttacacaatacacaatttgattcaagcgcttacaaaagcatctaacaccacacttatctccgttaaatgggcattcttctaattttacactaacgatatgatacttaattagtgtaaatctaatactctttttttactgattgtgaggaatttatagccagttttcttccttaaattgtcgactcaaaaagcgggtgtctaacgccagctcaacaacgtgaactggcgttagacacccgcatattttgtaccattaacacacatttctgcttgtttaacaagcccgatttcatccgacgctatctgctcatcgtctacgcaggttgggcgttcgaactgatcttagctttatttagcaataccgaactcgtgactacggacaatgaactaaaggccattgctaatccggccaattcggggctaagcgtcagcccaatggcaaagaagaggcccgccgcgactggaatcccgagcacgttgtacacgaaagcccagaacagattaagtttgatacggttaaacgtcttcttactcaatgccaacgcccggtcaacatcacgcagatcgttcttaacgagcacgatgccaccagcatcgattgcaatatcagttccggaacccatggcaatcccaacatccgccgtcgtcaacgcgggggcgtcattaataccatcgccgacaaaggccaccttgccagccttctggaacgcgtgaacgtgctcagccttatcacctggcagcacatcagcaatcacttcatcaataccgacttgatccgccacagcttgtgcgacccgttcgttatcgccggttaacatgaccgtcttcaagccacgtgctttcaaactcgcaatggctacctcagacgtcgatttggcgacgtcttgaatggcaatcaatccaatgatttcgtgatttaagcccacgtacacgaccgttttcgccgcgtcctgaagctcagtggcttggcgttgtaattcagcactaatcggctcatcagttaataatttatgattaccgaccaccgctaattggccctcaacttgagcagtcacacctttaccctcgatggcttggaagttcgtggcggttggtgcttgaataccacgggccgtgccgcgttttaatattgccgcagctaaaggatgttccgaagccgcctctaagctagtggcaacgcgcagtacttgggcttcgtcgccgataacatcggtcacttgtgggtgaccaaccgtaatcgttcccgtcttatcaaagatcaccgttttaacgtcattgacagcttccaagacctcaccatttttaatcaggatccccatcttggcaccacggccggtaccgaccattagtgcggtcggcgtagctaaacctagcgcacacgggcaggcaatcacgaccacagcgaccgcaaaaatcaaggcattcgcgagactagcattcaagaaaacataccaggtcaagaaggtaacgatagcaataattagcacaatcggcacaaagatatcagaaactttatcggtcagcttttgaatcggtgcgtgactgttttgtgcttttttaacgagctcaacgatttgagccagcattgtctggtcaccgaccttgctagctttgaactgaaaggtcccattactattaatcgttgaaccaatgacagcgtccgccaccgttttttgaaccggcatactttctcccgtcaccattgactcatcaaccgttgagcggccagttgtaattacaccatcaacgggaattttttcgcctggcttgacccgaataatgtcgccgaccactacttgatccaacggtacttttacaaattcttgattgcgtaacacttccgcttccttggcttgtaagcccactagctttgcgaccgcgctggacgcgttgtgccgcattcgttcttcaaagacttggccgagcaaaacgaaagtggtcacaagtgcggcactttcaaagaagactgcttgccccgttgccattgcgtataagctgtaaaaataagccgtcgcggtgccaatcgccaccaaagtatccatattggcatggtgcttagtaaaggacgcccacgaactttgcaagaacggccgagccgaaacagccataatgatggtcgtcagaatcaactgcgtccaatcaccacccggaagcatccagccaaagggcatcaaaatcatattagccagtagtggcagggaaaatattaatgaaatccaaaaccgtttcgtcgtgctcatcacgcaatcaccaccttgccactcaccatgtccatcccacaactaaagtgaaattcaccggctcgatcagttggtaccgtcaccgtttgcggttggtcaaggggtaactcagtcgtaaagtgcaagtcggttgaatgtacttgctctaagcacccctgcgtactcgtgcgcgtaaacgttaattgggccggtacaccttgttgtaacgttacttctgctgggtcataatggccgtctactgtaatcttgatttgttgtcgtgcgctcatttgattttcctcccactatttaatgattaatttcccatgaaacatgtccatcccacaggcccattgatattcgccagacttactcgtatcaatcgtaattgcttcaacttgattttgtggcaattcctgattgataccgaaatcactgaacaccacgtgatccagacaaccagatgcatctttgcgcgtaaaattaagtaccgccggaaccccttttttcaacacgatttgttctggcgaatagccacccttaacctccacatcaacctgctgtagatcatcaactgcactcgcggtgaccgttgtcgtagcatgcttcccgaagaaccaccacagaataaacccaattgctaacccaccaattaataagactaatactttaatcatcattttattcgtccctttctcattatcgtttacacttgtaatctatatgtgtatattaatcccttcgtttacaattgtcaacgataaatgttatttttaggcataacccttaattttttaaacgccccacccagttgctactatcatatgtctgacatttagtgtcactacgaaaagtgccgcgtgtgttcctttgctcagttattagtcgccattttgaccggtcaactgaccgcatcaaaagtaccaacgacgataccataaaaggcaatcactaccgtttaataagaaacgtcagtgattgcctatattaatcattcaaaactagctgtccctcaaaggaacattaaccccgtcaatcccggttcctaaagatccgcaactcacaacgggtatcatctcacaactgttaatcgcgggacttaatcttcagccaacctaaaattgaactcaatgctaatccaatcatccccaagagtgataattgcgtattctgctcgtctgtctggggaagggtcgtcatccgatggtgcttagtggtacgttttgataccgcctgtgcactaacccaaccaatacctgaaacggacgcagctgttttctgctgattcgtctgcacaacgctttgatctgactctgcttgtgatggctgtgacgtccgtgattgttcagcctgattacgactcaaattggcttgatcacttaatccatctggttgctcagaatcagctggctgactcggtttttgcagttcccctggtttttcggattgacccggttcttctggttgacttggttgctcagggtgccccgattcttccggttgacttggttgctcagggtgccccggttcttccggttgacttggttgctcagggtgccccggttcttccggttgacttggttgctcaggatgccccggttcttccggttgacttggttgttcaggatgccccggttcttccggttgacttggttgttcaggttgacccggttcttccggtttgattgccgatttcttgtaagtaaccactataacctgatcggcagttgtgacactcacctgctgggctgccacttctgttaatgtggtcgtggcacccgctacaattggtgaaataacgcccgccatttccgttaccgagactggtacccattcttggtatgtcacttcgcccgtcactaaatcaatcatcgcattgcgttgaaattggacggtttgtaggaccgaggctgcggctgtcgtgccatcctcataaacatagtgaatgattctagtaacggtgtgcgttaaatcggtgtcgccaccctcatctggaaataagatattcggattgtcaggatcaactggctgtcctggtcgagcaggattgcctggtgttaccgtaataatacgatggtcataagtcacgattgtcgtcatcaggtccggatcagtaatcgcgaccgtttgagccgctacagtccttatgtccggatcagtatagccttggacgactagcgttggtgacgttaccgcggcaaattgaccactgccaactaaaatccacgcataatcagcttgactcgtatcaactaatccatcaccgtttaaatcatagcctaaacatttgccagtctttttttcaataattgctgttcgttggtaaataaccaattgctggacggtcgtggcaatcgattgatgggtctgtcgatcaatatagctgataacgcgccgtttattttgatacaccgtaacggcctgagttgctagtcggtaataaacattgatcgtaacatctttatcatcgaccctagcaaccatctgctccggcactacttttaggtccggcgctgcgtagccctcatggctcagatctggcgacttaaccgcgccaaaccacggccctgaaccaacaatcaaccatgcttcatctgccaattgtgtctcaatctgtccgtccccgttggtatcgtagccaagtatcgttccgtcatgagcaaccacagctaataattgatacttaaccgtttgaacaacagcatgtagtgacgcgatgggttgcagtgttccaccatcgatatagttaatcgtccgggtaaccgttcgctgcgtcgttgcaatatgcgtttgttgctgatacttgacaattacatttgtattcatcgttctatcaccaccattaatgatcactgtttgccccgcaactaccggaatatcaggagcttgataaccctgcgcagataagtctggtgagacaacctgtacccaatcttgatccgttggcggtactaacagccatgcaattgtcccatcactagtatcaacaattccgtcgccgtttgtatcatagccgagcaattcatgagttttagcattaaaaatggcaaatcgcacgacccgtacattttgtataactgggccagcaagcaccgccccagttcgctcatcttggtaattgatcgtccgcgttatcgctgaatattccggtatccggctgataggtattatgggctcatgcgatggttggacgttcaaccaagtcgttgcagtctgatcgccaaattggtaagtaattagatagcgatgctggcccgcaatatgtgtatcaactgcattcaaccctgataaacgtgtcccagccgcatctgtaatcgtgatcttcagttgcccggttgctagtagatggcgaaaaccagctaaagtatcaatgctcgtaccatccgacttaatcactgcaattaagtaatccaacgggtcatcagtaaccacttgaccaaaaccataattatgctcgttttggctcgtaatcgtctctcgaatagcactgtcaacatcgccatatccatattgtaaaacggccgctgaatcaacattttgattagttgtaaagacagcatgtggtgccacgattttaccagttatcatcgtggtattctgaatacgcatggcatgattgaagttccagactagattcggtgtactactagaaaaaccgccaccaatggttaacgctggtgctgccgtgacgacgttataaataaccacatcatcattattaaaaccagtggtccgaataccactgtgccagtcattcaaatcaatattcacggcataataatggtgtccttgataagagccaaaatcagcagttccagactcaccaatcagcatcttactcaacgtgccaccattagttgccgataaaatggtccctgcagtaactagttgatcataaaagtcactaatattgatctgagcttgactaaattcttgcgcattgattaacgaagaatcaaccgtaacgcttggtaaacctttgattgcaccatttcccgttggccgaggctttgtaaaatccatatcctgattagctacgggacggtccaccaatccattggtagttgtaaacgtgattgtattgtttgtcactgacaaaccaccgtttatgatggtctcccattcatcatcctggccagaacgaattgtcgcccccgtattgataacgtgcagaccaccactaatcgtagccacactaccatcaaacgaactattcacaatcgtaattcctgtaagtgcaataattcgatacgtggacaaccaatcttggatcaaagcaatcaaagccgcttgcccatgctgtttggtatactgatcaagatagttcttatcggctaagttctttactattgtcaaaaacgacgaagcggtgactgtccgttgcttgctcggctgctttgttgcaactgatatgtttattgacttagtgacatttgttttattcaatgcccttttctcaaccctgctgctcatttgatcagttgccgctacagctcggcttgaatttgagttcacaggggtagttgtcgtcacggtactcactgatgactgtgaatgaacagtccccgataaatctgaatcgatcgtcttaccttgaccgcctgagtgttgcgcctcagataaactttcagaatgggccccactgtcagcacctagtgcgctagctgaactggccatatcaatcgcatgatgagtgccagttgagttggttgctggcgcctgatcagaacttgttgcggctgacgcctgattagtactggcacccgcagaagctgctgttgagtcacttgcctgttgttcaacagctgttttatcttgctgtgttgaccgctgttgggcttcactagtcgttggactgaccgcctcaacagtgccagtcgtagcagattgctccgaactagtcctgtcagctgacttgctggactgggcggtcacactgtggcggtcacgagttaccgcagtttttgaaatccgtgctacttctgttaattggtcttgactatccgtttctaactgcaccgaatgactcgacatggtaaccgtctcagcttcacttgcttgagccactgtcggcacaattctccaacctaaaattaaaacactagaaaacaaccaaaccttgggattggttacgcgccatttgccccgtgtatatcgcatagtaatttgcctctgttaattttagtcaaatatcgacatattttgaattttgagacatagtatacctgcttttatgcgagtaaaacgggggtttgtatttacgcgaaaaaggttatctttaaaaatacaagtactaatcagttcgtgtattaagttgtcgaaattctaagggcgtttgaccggtctccttcttgaatcgttttgaaaaatcggcggcatcgtagaaacagagttcagcagcaatggctcgaatggttaaatccgttgccaacaacatatgctcagcttcctgaattttcttggcattgatgtaatcacgaatcgacatatgcatctcttgactaaacgaccgccgcactgactcaggattgcaccgcgcattgacgtgggccaatacctttttcaccgataattgatcatgcaggtgagcattggtatagtacatcacatcgagcgttgactctaaatgtgcgttataagctaatgcgttcggtttggcaattgcggcaaaatcacgaataatctgcacaactagtggctggtaacgttccgtcgtcacgggtaatttaactaaccaacggtgataatcattacgtagcttaacaaattcataaatctcagcatgattttggattccctcaaaagctaagacatcaaccagcgcactgagttgcagctgtttttcctcactcgataatttatttaataaatcgcgcgaacgggtcagatttttcttagcaaattgaatgccttcttcaatctttccggcccggtaaaatcgaataaaatctcgttctaagtaacctaataagatcagccccttggtggttgggtgctgatcattataatcacgcatttgatgtaaatattgtacaaattgtagttctgtccccataatctgtaactcctttacgttattggtcaaaatttgttaacccaaaaataatgctcattttaacagatgtctagcagtaatactatttacatttgccatctgacaatttacaatgctaactaatcccgctgtacactaatgattctaacaaatattttttatttaacaatcaatacacaaaagcggttatccctcgtaatctgggataaccgctttaaagcaatcatttttatgttaaccaattcacataaagtgaaaaaagtatggtcttaattatctaaaagcttatcgttaaattctccgaccagcgctcacattgccattcatgagttatagcaatgatctaaaaaattgttttaaatcttcgcgagttgccggtgataactgtgggtaagcgcaattttcaattgcgccttgtaacgaatacaataattgaatacaagcgtgggggttggccttttttatggcagtaaaagcgactttgctacccgttgactttagctgttcgggtgtcgtaatcgcaacggcttgcaattgtttggctaatgttggcccaatattaggtaatgttgttagtaatgccaccaaattcagatcctttcgattcataatcatagtttaatgtttgataatgagctctgcaataaagttgccctcttcaatacaataattaacaactaattgatctgtagttaattgttcaatactactcaatccataacccaaatgtcctggtttagttgtaaatcgacttttcttgataactgataaatctaccgcttcatgcgttggaatttgatttgtaatcgaaaataccgttgtgtgagcatcccgatttttaacagttagcgccacttgatgattcgctcgggcagcagcatccgtcgcattatccagcaaattacccaaaatccgcactacttttatctgtggaatatccgctaacgtgactttctctaagattgtcaccactaaatgaacgttctgaccgttggctgcctcatattttgcataaatcagaccactgaccgtcggcatatccaagcgactcaaatcactcagtcccggctgacgattaagggttaccctggcaggcattacttccgttgtaaaataacgctttaagccggccatatcattgttctgaataaatgccgacatgctcaaaagaatattctcataatcatgtttaaacaaatgtaaatcacggttatggtggcttaataattcgttgtaatttgagacttgtagcaatagctgcgcatcattcaagtgactgtttttattactaattaaatacgacccgataatgccaaacgtcacgatggccgcaattgccatatacgtttgcgcattgaccgaccattccatcgcaaaaacatacgcaataatgtaaatagcaaaaaataaaataactaataagtaatcgctaatattaacacgcgcccgttgcaaaaaatcggcggccgacacttgtactaaccagcgatgcgctaacatccctaaaataataatgaccggcagcatcataatcgacgctaaaaagagattaatatccgctgtcgaatgtagacctatcgcttgccgtaataacattggcgatgcagattgggctacagccttggcaatgacacccatgattgcccctactaatcgcttaagcgcattcaaaaagattgccaccggtaacattaaaatccactgggtgtacaacaaccgagaactcataaaggtggtcacacaaacaatcgggatgatccaaaaataagccagggggacttggggccataagtttgaagccacttcccccaggctcatcgtaatgataaccagacttagccaaatgatggcaatccgccaagtgacatattctctaaaaccaatcattaaaaacaacatttcataaccgccagaaatcaacgacagcgctaaaagtactgctgacacgccaaccacctcatcatattaatacatttgttagttcactttactatatcagaaatacggcttcattaaaccctttactctatattgtaaacataaatttgcattaaactataataaagcccttacaatcttattattaattattcataaaaaaagacattgcaaatcgacatacttttgcaatatcttttaaccacttatattaatttttaaggtgtatcctgtaaggtccaattaatcgtcccactgtaactgtcaatttgcacactaggttggacatccaataaaataccctgactgctcgaccaaccacttgcagcattagtgctcgtcgtacccgcgattttcttgccagaactgactgttaccgaagtattcgtcagcacctgtttgttccccgcgttcagataaatcaggttgccactcatggtccgcgtactggatttcatggcagttgctgtcgcccgtaagtaccactgtgaaccggtcttccgtgtgtcattaacagtgatgttccaagcatttgtcggctgatatagtgtttctttaaacggaatcgtcagggtgccaaacgtcaaacttgctggtaatgtgcccagactcaacgttccatcccgcatcgtcacagtaattgccttagcatccgactttagtccagaactgccttttccataaatattgatcgtggtgctgctaccaacggctaaactactcaacttgctcgctaaactagtctcgttggccgcgtaagtaattgtgtcagtcgcactatccggatttgtcgcaacgatgccagcttgcttaactaaccaggcgacgaccgcgctatcacttgtcagtgaatctaagtcaccaggatatagatcgactgccgtctttgaactagtaatatttagttttttgagggtcaccgctgcggtcgccgtccccttgtcaccggtaatctcatcgacctcagtgacggtgacgttacttaaagtaccgagtgcagtcccaagattcagcgtgtacgttccatcgcttccgaccgtcgtcgtcacaccattaacattactactgatcgtattgccgggtgtcccggttcctttgatcgtcgtatcagtcgaataaagtgtccccgtaattttaggagataatgtctgcgcgttgaaacgccccagctgataggtaccttcctcaccattcactgtgattcggaagccaatatagattggcaactcacttttaatattttgaaaattgaccgataacgtctgcgtctgttttgaagaactaatcataatcgaattgccactgccaagactagtaggtgtagccgtaactaatgtcgccccggtgtagctcccacttgcccgaccagccataatatcaaaataagcttttgacatcgagttactagattttaaggtaatcgaacccgtcatcgtcattgtaatttgggtcgtctgcctcgtaattcgaccattatccgcatagttagcggacacattgcctaatgctggatacgcttgcaaaccgttatcaacattactaccaaccgaattaccacccggtacggcctgaaaagcagcattagctttcacgtccgtcatcttgctcgtcaaagtcgcggcgttaccctctaagggcagcaaattcagcaagccgagtataccgaatacaagaattagtaaccattttactcgtctgttacgcattccgttcacccccatctgccgttttaatattcggtacaacgcgcctgctaaaacactagctaacaaccccatcccaccaaggatactgccaatgacaagccgctcactcgtttggggcaattgttgaccattgcgtgattgcccacgcaaccagccatcgataattagttgtcggcggattggcttgcgctctgactgatttctctgaccctgggtacccgggtcagctggtctaataacgtacgggtgaccaccatcaggaatcacacgggcgggaataatccggtcagcactatacttagtctcataaaaccccacactgatctcagtgcgaccgtgtgttgccgcccgcactggtattgcccagctcagcacgatcattacccctaatattaatcgccaccatttattcggcatggtccttcccccatttcactgaccgaactaagcacgccgctgctttttgatccagaaaaagattaatagaccgattaatccaataattaacatgcctaacgctccgaatagaataaaccagccaacgctcattcccgaatcatcaacggaagcctgattatacttatctgccgcggccgtactgatgacaaaatctttatcaaacacccatcgatgatcggtatttttagcaactagccggacatgctacgaaccagcctgcaaacgattggtccctgtcaaaattggtactttataaactgagttaggtgctaattgcacattcttctgtgtaaagttcttgatgaccttgccactattcttactcgttaacctagccgtaatcgttagtttggggacgatcaccgcagtaacgttgcgtaattgtggaaacacccctcgccgataattctgcatgcccgccgtaatcgtatcgagcttcaattgtggttgtggcactataccagcagtatatttcagtccaatcacatacgaatactgattggcaatattcatggaacccttaacacttccggtgactttattggcgacccgtttaaaataccagccgcctaaaatcacaccgttcaccgcttgcttaggcatcgtaaccgtcgccgttaccactttcgacccgtttgcgggtatcgtgatggtcgttggtccctgtattttggtgatttggtccattcgatacttcaaagaaggatcataacttttagttggtgtcacgtactcgataatgccattgccgttcgtataagccgtatgaatcgccgtttgaaccttgatgtcagcgttggtgacgttataaatcgtcgtctgaatctgttgctgtcggccacgcgtcatttttaaatcaaaataggaattatgttgatcaatctgattattcggaatcttcgcggccacgctaaacccgatgtcattgctttgcgtggttttactgctactgctacttgcgctactggctgccaatccactaacgctgctaacttgcaggcctaaaattaacgtccccacaataaccatgattcgcttcaataattgcatcttctcgcccccattactcacatatgtacttggggcgccgttcgccccgatgacgcttaatttgttggtaaatcactcaatgtccaattcaggttagcgctataggcctgcgccttaaccgtattagccttaatattcagtgtcaacgcctttggatctaagcgactaacagttaccccagaaccaccgcccttatcggcatttaagacggcacttgatcccaccgtaccatttaaagcaacttcggaagccgtggcaaccgcaccattggcctccgagccgctgttgaccacgtcaccttttggtaaactgagcgttgcgccctttgcagccgtaccatccgttcctgttaaattggagccggtaaccgttaatttccagccggcattggttccccgaacatcagaaacttctacaaccatcttatcctgccatagcaaagtatatgaactagttgggtcaatcttatattgttgatcatttaaaacgtccagctcatgcgtcccgtatcctaacgatttagacacaaaaatcagcgaaaggtcgccacctgctgccgccccgttgtcaccatcgccatcagtacttggcacatcaggatttgatggatcaactggcgtcaccgtggacgtactcttcgtaaattccgctttgatatccgtattcccactacgattttctgcagcattggcaacaatcggtgtactacccgctaataataaagttcctgccattaataagtgtcctaacattggcttcatggtatatcctcctttttcatttaccagcgcttgtttagctttcatcaactaagaatggtggtcattatcaacaatgattgctctcctaacaattcataaattactggcactaaatcacttgtgacctcccccaataaccttgtacgattgattaattaatttaaatgccgactcctttgaccacattttcattatattggtcggtcagtaacagcgctaataatgtataacgttaactatatttacaaacccggcttgttcgtgtaatcgttatcaaacgtgggttgtctgagataattaggcgaacttcctttaaaatcgctcgctgacaagcgatgactgtcagaataaataaattcatatcaacaatttagtctcagcagtaaattaattatttttctgccattgcttctggtgctgcaccacaaaaagtccaacccttgctgacaagtgttggactttcgtcatcgatattcttttcaagtctgcgtattaccacggaggaatgccattaacattagtaaagatcgccgtatcgatcacctttcggattgttagcacgccggtcctttcacagataatattggtcgcaactttagacgcgcgggagccgactgtccagtcctcctgccaagtaatcactttaaatcaccaaaattacaatactatcgttgacatagtattactgattaattaatcaggctttcaatcgttatgctgaatcaactcggtaataacacaaagcgctggtgatgatccgtgcctgcttccaattgagcgtgacactgagcggcatccttaaaatatcgctggctgacctgatcatccaatagcagtccggcgctaaaagctcggtttaaacgactggccgcttgtgctaactggtcaaccgttgcatggctaatcacaaaaccagtgattcgctgttgagacatgtaaaactggcgaacagggaactcaaattggttatcctgcggtgccgtaatcaatgtcacctgaccacccaatcgtaataacgctaaattaatcgccagtggtacgcgtcccgaggtatcgatcacatggtcaaaagtccactgatccgtcgttaactggtccgcaaaccccgcgtgataatcataacaggcggtactgcctagctgctgacaccgtgcaaaatctcgtggtgatgcggttatcacaaccgtcacgcccatttgatgcgcaagttgaatcagcttgcggccaacgttgcccgcggcaccttcaattaggagtgtctggccactacaaatttccatgacgtcgttaagtacgatggcggctgttgcagctgaatggaccgccgcgacgagtggcatgggcgccacgccatcaggaacgtgatacaagcgatcagttggcaccgccacatactcggccgttgcgcccattcggccttcatagcccattgagttcgtccagacttggtcgccaatttgaaagtccggttgcgaactggctacgacctcaccgactaaatcacgtcccgccacgtgtggtgctgccagggccgtcttaaacgtaccactccgaacaaacgtatcaacatgattaacggccaccgccatgatcttcactaagacggtcgcagttgtcgccaccggctgttgcacgtcagcaatgcgcaatacatcgggactaccaaaatcgtcaaaaataactgccttcactattatgccttcttcatatcgcaattaacaagttaggttatcggctgggacgccctgttcaaaagcagctaaaacttccactcctttagcgatttgaacggcattgtccagcatatgagcattgtccttaatagcgatccgcccctgatcgtaatccatcttaataccatcgttaaagaaaatgagatcgtatgtggaggtccaaagcgcgaggccttgatcattcaccaccgttacgttgtattcggggtccggctggtcaagtacgattatcgtaaatttagttccaatactgcaagcacccccgtgcaaagagtacttgccaccaccatcatccgtcaccaaaaccaattgcttcttatcaaagcccttcgcaaccaataaagctttcagccgatcactaatctctatttgcgtcatactatcagcaccccttaattataattttatatgagttaaaatataattaaattatattcgtgcttcacgcccaatgccagtcaaaagttttcgcattaattcgacgccactcgatatcggagaatggttttcagtttatcaggtgccacccgccgtgcatcggataaataaatttctcgatgaaccttgctagtacgatgcatcccctgattggcgaccagttcatctatcttggcaaaactcgcgggttcatcgtcataagcacccacgtgcagaatctgtgccacttgcattgcgtcgaactgctgtacgctaattttttcagttggcagttgtttcttaactttaaccgttgccaaagccggtgcaatcagttcagtgggaacaaagtctggaatccgaatcataatgtcataactgaactcgtctttgtcaaggtggtcaagttgctgtcccttagtcgtcagtgaccagaccccttcaagtggaaaaacaacgtaatcatcaaattcacacgcctgtgtttgcgcatattgcttatacgcatgcttgagcccataagcagctggatataacgtttgcaggtgcgtctgaaactctgggccattgggattccccgttccatggatactcataaaagtttgggctggaatcgtcaacagttggggttgcttcttagtagcataggttgttttttcttgtttacgccattcatacttcatcttcattcacgtcctttaagttaactacactttcattatacttagaaacaatccgctgcgcattgcctgcaaaaagataatgagtaagttagcaaaggtaaatttatattcattgccgccgaacccacaaaaaagactcggccaatctgaccgagtccgtttataacagtactaatgactatgaatttatgatttatctttaagccgttcttctaatcgcttgatctttagctgcttgcgatgaatgtaccaagcaatcagtaacaacaagatgactagcagaccgaggctgatccacaacacccagttagtatgatgttcaatcacggcggttttgttgagttggttcgcgcgatcacgcgtgatttcaaaatccttggtgaacgtccaatgttgctttttggacgtcacggccaacttagcggtatattggccgggtttcaacgcatcccggccaacccgtaacggtaaggcataaactgaattaggcgccatctgaccgtgttcattgacctgcttgtagcgcactttgttactaccacgacgatagatttggacatcagttttgacttgattcaagaaagcggccgttcgattttgtaggggtaaactaatttggttatacccgttattttgcgttgcatcaatcttacccaatgttaacttattcttggtgagcgcgtggtcaccatgcaatacgaccgccactgagtaagcgtattgattcttaatcgccattgcgctcttactctgttgtttggcggccttttttaagaaactcagtccaccaacgacaacaccatcatacttctgagccggcattttcaccttaaaagtcacgatcttactggttcccttagcaaggataatcttattcgccgccgtcgtaatcagttgactagcatcagctggcaaatcaatgttcttgccatcagtcgttgcctgatactcaaccaccccattgggattagttgtcgccggtacaattgccgtatgcacggtgatttcctgagtacttgtgttcgtcactttcactgccaaagtggttgtttggctaggttttagtttcagatcatagtatgaaacagccttatcgatttgatatttggaagccaccggtgcgacctcaaaaccgaccgtgttagccgaacccattcgtccccagcttagactagctaatccgactagcaacccaattcctaactgccaccatctctttgttaacatcatttctccccctaatcatgattcggaaaaatgacattaacccctactagccattatttttccgatcaatacttattagctgttcgctggtgcagtattcaagctccaagttaatgttgtactataacttcccgtagctcgtgccgtagtcttgggaaccattagttgtgacttagcaatatcagccacattcttaccatttcccttacccacagcggcggtcatcaaaaccttgtcactattgagtgtatctagcgcaacaccggtattggccgttgcgtccgcaccagtcgtcgatgcatttgaatccaaaacaccattcaatgttagaatcgcacccgtcaattctttattagcaaccgctttgtcgttcttaaaaacgtcattttgcttcacacgtaaatcccaaccagcagccgttccccgtaagtccacaacggataccgccgctgacttattcgtgttgtcatagttatcgtctttgttagctgcggtgatttggttagtaccaaagtcaagactagcaccggctaagtcagtatcaccattatcaatagtgatatcgcccccggtgaaaccaaccgtcccattagatgtttgtggcgtatcggccgcactcgcggtcaaacctgatgttgcaatcaatgctgctgagaataaaagtcctaataatgtttttttcatgataatgaactccttttttttagatagttaaccaattgccaaccaattaaaacgatcagtaacccaataccaccaatgaaagcactcagccaccattgttcactcgtttgtggtaaccaccccgggttctgatgatgaacagcttgactagcattcggctgatgcacaatcgaatgactcgactttgacgcttcagtcacatgtaactgattagcgccagtgtctgggttcgatgactcagcctggccgtcgaagcgaatcgttgctgggctctcagccgtactagccacaccaataatcggtgctgacaaccacccccaacaaagtagggtactgatggcaattgtgatgaaccccaaacgcttcatcaacaccactcctcctctatatcattatttgcggtacaactaaaaccaaccctgaccgaagttaatcattaagttggagtagttatcatggtacattgtaaatatacataactaaatcactaacaacaatcaagcagtcttacaaattttgtgttacctaatcattatttttttcatcatcgattaggaaccccttgattaagcgtccaagtgactgtcgcctgatacgtatccgtcaaggcacgatcggttggcacttgtaacgatagtgccccaagtgccgttttctgactgaggatattgacgccttggttcgaaacagtttgatggttattgacgatcaaccgtgccacacctggcgtaagaattgactcgccacccgtttgttgatccttataactgagcacagccgctaatggtcgtgccgactgcttactagtgaagcctgatgctgagagcgttgcattgagcgaccacgttgaacctattgaccggccatcttgaataactagcccagtatcataggaggcaccgtaactttctgatttaccagtaatcggattctgaccaaaattaatggtctgcggtgctgagacaaacattagtcctccaggattgtacattaacgtaatcgtttcatctttgtcggtaaagtttccttgaaccccatctggttgatctgccacgtacccttgaatctcaattggcttaatatgataggcatcaccagttgcaccactgattttcgtgtcgggtgccaaggacttgccagcagcgtccacatacttcactgtaatcgtgttgccagtggcccattcgaattctccaacaatggttttaccatcgtatttagtcatcaaatcagccgaagtataaacttttttattatttaaactacgccatttcccaatataaggtgcctcactactaggatttggcaagtgccaactttcactcttaaaaaagttaaaactgggtcccaacaatagacgtttaggcggcaacttcgaactgaaagcgttggtataagtttgcgcactgttggtattccagccagtcagatctaatttgtctagactggtattctggaaaaatgattcaaagttagtcactttggtcgtattccaagcacctagactcaaggtttgtaaacccgaatcttccgcaaatagctgtgaaaaatccgtggctgaacttgtattccagttttcaatgggcagactagttaactgggggttgccgtaaaatacttgtcccatgtcaacgaccttcgccgtattccacttaccaactggcaaattcttaacttggctaactttggtaaagattcccctcattgtcgtcacattaccagtctgccaattatctactggtaatgccgtgacactactcatttcagaaaaagtccccgccatattttgtacattcttcgtattccacttactaatcgggagactctttaactgactaactctagaaaaagttccggccatattcgtgacagtaccagtctgccaattatctactggtaacgaggtgagactagtcatgccctcaaaagtataaccaagattggtggcactctgggtgttccaattcgcaaccggtgcagttgttaaactggcacagccactgaaggttgaattaaaatcaaagactttgccgacattccagttgtcaatcggcagctgggtcaagttagtatcgccataaaacgtgctccgtatcgtttgaacgttacttgtattccagttgtcgagtggcagggacttgatattaggaagcttagcaaaagtcccatccaacgcagtggcccgactcgtatcccaattagcgacgttaatactttccaagctagtatcacctgaaaagactaactgcatattaaccacgcgtcccgtttgccacttatcaatgggtaaactcttaaccttcgacattcctctaaaaatcgcggacatgttcgttacgacacgggtgtcccaattagcgatgtctaatgacgtcagcgaagaacaatccgtaaatgttcgcatcatcgtcgccactttactggtattccacttgccaactggtaacgacgttaatgaactgtcaccattgaaagtgtcaattagatactgtaatgaatccgtgttccaattggcaacattcaacgtaactaacttggcacaattttgaaacgttccctccattctgatgacgctgctgacatcccaactattcaagtccaacgcgcctaactgtgaacagttcaaaaatagccacgagatatccgttacgccagttaaattaaggttggccagcccatcaatcgccgtaacattaggtaagttagcaaacagatatgaataattagtcatagtagttgccgttatcttaccgtcgatgacgatctttgaaacttgggtcggttgatagccgttagccgtcaaggtttttacaatccaactccccgtggctgaccctagcgatgcaccaaatgacccaccactcaaatgcaatgtgccattagcatctaaggtcattttaaccgtcccattgaccatttctgccgctttggtcgtcgccgtttctgatgtttgattatttttagcgttttccagtattgtactgccactgctattgccactgctattgccactgctattgccactgctattgccactactgataccactgctgataccactgctactggtactactgcctgatgttaaatccgactgcttgtcaggtcccgaactttcctgggcctcaggtgacacttgtggtgccgagttgtttgcctcatcttgcaacgtcaatttcgaagcagaaaaaacactgctagtcgatggcattttctgatcaacactcaattgtgcgcggggaaccgcccgaataactgtccgtgatccacgatatccaaccacaactagcgctagtgccagtcccaggccgccccgataccataattgccggtgttgcatgcctatcgctcccttcacatagatagtattttaacatctcttgacgttaattatcttacattattttcagtttgtgacgttcagaaaaagacttacaattttacagatatccgaatattaaatttttatcaccgtgatattatttgtgttaataaccgtaattaaatgataagtatcagctaacgaacacccattttcatttacttgtttattcagtattcttcatggatacaactgcacgatggtcatttttgaagtgactcacgaccaagtcatttttcgagcgaactagatggcttaccaacgctgtagtgccttttccatcatggtccactatgaacagcccaaattggccaatttatatgcgctcacctaacctgctaatgacgataagctatctgcgttttttcaattattttaatattcactaggccacgttcaatctaattgatcagcaagcaacaaaaaaacaattccccaaaataccgaggaattgttcgtacttaagatatttaacgacccgtcacttcttggtaaacgtccaaacagctgctggggcattgccaaccttaactttaacgatctgatttttagcattaacgaccgtaaacttattagttgctgtatagcgtaaatatagggtcttagtagtcgagcctgacttatagctgactttccagaacgttggcgtcttggcagtcatgctataactcgcatacgagaccagctttttaacttgtttgccattcttataaagcgtctgattaaatccattcttagcgctaaacgttaagatttgggagtacttgttagtcgtattcgacttccaagtacccgctggcgcgttgactttaaacgatttagtcgtcttcttggatgacgaagtggccgccgtcgatttagttgccactttcttagtcgtggttgtcttgttagtcgtcttcttagttgaagaggcagtagttttggcagtctgaacacggatgacgcggtagaaataagccttagtcgttggatttgtggcgtacacataaacattgctttgcgccttcaatgtcttggctaatttaaccgtgtactttcccgttgttttagaggccgttgcagttccaagatttttcttggcgttggccgtactttttacggtgatcttagcgcccttggttgccgtacctgtaatttgcgtcgtattattgtaaattgcattgaccttcaaacttggtgcgacattcttcgtagccgttgtcttcttagtcgccgcattcgctgtaatccctgtaacgggtaccgctgctcccagcgttgccaccatggctaaaccagttacagcaatcatcaatttcttcattgatcaagactccttcgttccactggctaacttgtcagcgatttatttacgcctcgtagtatagcagtttttctatcggacaaccgctccttattaataatttaataatctttatgctttaattacaactgaatcttatcgaactgattttaaatgcgttatcacatccgttaacgacggtacaatcgcagtcgcctgatcagcatagggctggttaggccgtttcatatccggcacacaaattaccggaatcttcgcggacgtcgccgcttgaatgccagcttcactgtcttccagaaccaaacaatctgcaggttgttgttggagtttggcgcatgccatcaaaaatatatctggatatggcttaccacgatcgacatccggcccgaaggtaaactggtcgaaatattgcgccacatcatgggacgtcaaaatgtctaatgcccgcgacttgatactagatgaagctaaggccactgaataatgattccggtgtaaaaactgtaacaacacccgtgctcccggtttgagctcaacgccatcctgcataaacgtcttttccaacgttaacgcccgctttaatccagtatcaacattaaacggcaagtcaaaacgttcaatcaagtgttgcatattcgtcaccgccgacttaccactgtattcctgtgcataagtcgccatggaaagcgtctgcccataatcctgtacgattcgttgatacatctttaatgaaataacctcgctatcaatcaataatccatctaaatcaaaaataactgccttcgtcatactcaccaactccagtctatttatcgtcaataatctaagcttatcataaccatttgaaaatgtaagcggagtcattactactaatattaagtttcaaaactaaatctggttagtacagaatttgtgcgaatttctatatatttagtaagcatagtaaaatacccccgcagttctttagtaacaacccagtgagtttcgcagatgaactcctagccaaatccctacacaatagctagtagcaataagttaactccactgatttgttgtttatttagtcgtcaaccgacccaacattaactccccctaatcaaaaatggtgcgccagaatattttcattcttgacgcaccatttttaatttaaactcattgtctataaatcgtctcgatgtaacaaggcaatctcttcacccgcagctcggcggcgatcaatattatcctcaccccacacgcacagctcatgtaagacaacggacaaactccggccataatcacttagtccgtattccacgcgcggtggcacttgttggtacactttgcgcgtcacaatattagcggcttccaactctctaagttgttgtactaacattttctgcgagatttgtggaatcgcgcgttccaattcgctcgtccgcatcgtctgagtacgcagatggcacagaataattgatttccacttacccccaataatttccattgtggcctcgaccccaatatgatacgttttggtttccaataattgtccctccattccatacttactttttagtgggtatcccactttaaagtcggtacttgtctaaaattcacttgctagtataatcattatttatcaacttagcaatagcaggaggcttatcttatgacaaaacagtttaatcccggttggacactttttgcactcgcaatcagtgccttcgccattgggtcaacggaatttattagtgttggtttaatgccactactcgttagcaactttcacatcaacttggcgcaagctgggctgaccgtctcgatctatgccattggtatcatgattggcgcgcccgtcatgacattactcaccggtcggcttaaccgtcaccgcttgatgatgttaattatgattttatttattattggtaacttactcgcagcaagtgccccaacctttggtgtcttacttgcaggccgggtcgtggccgctttggctcacggtatttttatgaccgtcgcctcagtaattgccgctgacgtggtcgcacctgccaaacgggcctcggcgattgccatcatgtttacaggactgactgtcgcaacggttactggtgttccgttgggaacgatgattggtcaattaggcggttggcgctggtcctttatctttattagcatgattggtgtcattggtttgttagctgattactggttaattccacgtaatctgccgttacccagtaaagccacggtccgggggattatccgcgtactcactaatccacaactactgttcgccttactcgtcacggcgctgggatacggtggtaccttcgtagtttacacctacctatcaccactactagaacagcagatgcattggtcagcgagcgctgtcgttttgattctagtcgtttacggcttaatggtcgcccttggtaatacactgggtggtcgttgggccaatgcacggcccttaattgcactattcaagatgttcagtgggttactcatcaccttactcattctaagtgtcaccgggtacagtcactggttaggactattgaccgtcctactgatgggaatctttgccttcatgaacgtccctgggctccaactctatattgttcagttagctgaacagaatacaccacacgatattacgatggcctcagcgttaaatatttccgcttttaacgtcggtatcgcactcggctccggtattggtggtcaagtcacgaccaaccttggcttaggctggacaccgatctttggtgccatcatggttgctgttagcttagtcctattgttaggtctaatttggttagcgcggcccgcaaaaagcaccgaccggcattgcgttcaaaattaataactaaatgacccgtagtcgtcttaaacggtcatcgaaaacactaagcttagcggcttaacaatgaccgccaattcggttgtcctatcgctaggctgagtgtttttctttatgtcactatcttttaaatccacttaaccgtcactagttcaggaacctcattaataggcgactcagagtgctagcaatgaatcgtcccgattttcaccggcggccttcctacttttagttggaatttattgtttattttcagtgttatttgaagaccaattattgtcattttaggctgtgttaattgacttaaagcccgaatatgcccgctttacaccatcgcgaccccgatttgttcgtaaaaccgacttacccagcattcgactgggttgcattttcactttcagaaagctataacggtaatatacgattggtttccacttttactgagaaggtcttgattgaatggtcagtattgactattaccactaactatcaagtcagagccagacagaaccaaccaactatgggggcgcaacatgcaacgcaaatcaacattaattttattaactagcatcactttagttatcggcttactggcggtcggcactgtcaaagttgttggtgatgcccacagacctagccaatcaacggtaaccaccaaaaaagtcgtgtcaaaaacgaaagccaaaaccacggctaaatcaacggtcatgcgcacaccaatcaactggcgtcaatcatccgaaacagtcgcgtatcccaatgtcaaccgctatccggacttatggattcacgtatcgttggctaaacaacggctatacttgatgaaccatcaccacgttctctatacaatgtatgcatccagtggcgtgccaactgctgaccgcaaaacaccccgtggcacctatcatgtgcaagccgaacgggaaaaatatttttatagcgctagtgttgatgaaggtgcctattactgggtctcatggctcaaccatggtgaatatttgttccactccacacccgtagatgcccaaggtcactttatcaaatcagacgctgctgatcttggcaagcgaccgtcttcacacggttgcattcatctgagcgttgcagattccaagtgggtctataacaacatcaagtatggcactaaagtcgtcatcgactaacgaaacaactacaaaaccaccaaaataaatcatccagcaacctatttgtattaagacaatcaggtcgctggatgatttttattctcattggcacgttgaacgagttcttatttagctttaatatgaacagcttaaccgatttcgacttgctcagcaagatgattggccgttacactatccattaacatatcagcttccacgtataacttatgccacatcatgaaggtcagcacggtccacaattgacgcgaattatcacgaatacccgctcgatggtcatccaatagttttaagaaatatgtcttgtcaaaatactgatcggtttgcgacgtcacaataatatttttagcccaatcgtacatctcatctttgagccacaaccgaatcggtactgggaaaccaagctttttgcgatataacacgtgcgcgggtacaatatcttcaaccgcttttcgtaaaatgtacttcgtcgtaccgtggctaattcgcaagttggctggaatttccgctgccagattgaacacctcccgatcaacaaagggtgtccgcaattcaaggctgtgggctaacgctgtccggtccgcattatgcaacaaatccccatttaaccacgtgtgcatatcgataaattgcatcttagagattaaatcatagtgcttggcttcatcgtaaaagacccgggttgtctgttggaacgaatggtcacgattgtagtgcttcatgaactgctgcttttcagtttcattgaagataaacgcattgccaacgtaccgcttctctaacggggtcgtcccccgcataagcaacgaacgaccccgcattcctgctggcatcatcgcggctatccgttgaagggccccgttgattggcttcgtataccgaaaggctttcaaggattcgggttcatgataaatcgtatacccgccaaaaagttcatcagccccttcaccggtgagacaaactttaacgtgcttgacggcttccttagtcaagaaatactgcgggacagcggccggatcagctaacggatcatccatgctccagacaaaatgtggaaaggctgccatgaatgcttccggcgtgatggtcatttggacgttatcgacattcaacttagcagccgtttcctgtgcgacgtctaattcactatagccaggtcgttcaaagcccaccgagatcgtcttgagatttggattgaactgcttggcaatcgccaccacaattgacgaatcaatcccgcccgataagaacgccccaactgggacatcggaacgcatatggatcttaaccgaatcaatcaacgtctccttaagccgtgtcgcgtagtcctgttcagaacggacgactggatgaaactcccgatgataataacgcttgatttgcggcgcgtgtcccaactgttttgttaatgaacagcccggcgccagcatcttgatttcctttgtcagggtctcagtttccggcacatattggaacgtcaaataatcttgtaatgcctcttgatcaaaatgcttatcttttaaaatcttataaatcgccttactctcagacgcatagtaaaaatcatccccggcaatcgcataataaaacggtttgattccaaattggtcacgcgccgcgaataacgttttttcctgcttatcccagattacaaaggcaaacattccccgcagataggtcgtcaacttggcctggtatttggcgtacatccctaagatcacttccgaatcggaatccgtcttaaacgtgtagccttcttgaattaactgttcacgtagctcaacgtagttataaatctcaccattaaacgttagccaataacgttcattatcatatgacagcggttgatgaccacctgccaaatcaataatacttaatcggcgaaaccccatcgtgatattatcatccgcaaagtacccctcatcatccggaccccgatgcacaatcattttagtcatttcccgcacaacctgatcatacgcggcattatcaacttttcgccgatccgttaagcacccaaccaatccacacattctattcactcccacacttaagttattgcgactaatcaccaatattatcgttagtgaccaatcacaagtcacgctcaaatcacagacaacccatgtccagtacgacgatttgacctgcgaaataatggcaagccaaccttgatcataattaacagccgtacttgtggcgaacataacccacttgattcaaactggttgcctctaattataatttagtgtagcccgtcgcaacggccgttttaagacaggcggactaaccattacactacattaagaccttatttggcccattgaagataagttcaaaataaacgcaagcgaattgattggaacggcccagctcaggttcataattcaatacacctgaataaagcgtaaaaaaataaccgtttcagggaaatcaaattgctgaaacgattattttaccagtcagcaaaccgaatcttgccaatctgaattttactgccgtcaatataaatcgactaagatttcaatcagcgattgtttttgccaatctgccttactaagtagcgactggccgctgcggaacacaggacggtttcaccgttagccatcgttagtcgccgataccgtttatccaatgaccgaatgcgggtcagattaacgacatatgacttatgacaacgataaaaatcagaattcaaatccggcacatcctttaataaaccgtaatattcaagttcaccatcatctaaatgaacgataatcttatgtgggctcattgaactttcaaaaaataacacgtgttgcacgtccaacgatcgaatcgtctcaccaattttgatctggatataactattttgatcattgtcttcagctttgaaacgctcctgtgccacgcgtaagacggtatttaatcgctcgtataagcgatccggaaaatccttcaagataaaatccagggctcccacttgatactgaaacaccgtcaatgatagctccgtatgcgtcgtcacaaagataatcttacttcggatgcctaaatcacgaatttgactggcaagctgaatgccattaatatccgaattcaacgcaatatctaaaagaaagacggcttgagttggttactgacttttgacatgcgctaatatttcatgcggatcggcactcgttaggccaaatcccatatccaattgacgatcaataatcactttactgaccagttgctgcaaggtttgtaactgtttagtatcatcttcacaaatatatactttgatcattttatcattcccgctttaccgttaaacgctgaacaaaggctgaggccaataaccgcgtttccaatatcatattttcatttcgattaacaatggcgctgagctgactcaagcctaagccccgctcttgtcccttagtcgaataccccgcttcctttagctgccataaaggtggcaaggaatcaaaaacgttattttgaactaagaacaccgtactgtgggccgtaacaaaaatggcgctcatcagctcaccatgatagtgaccggccgtggcttcaatcgcgttatctaaaataatacctagcgcaattgccaagtctaattcattcgtcgttaccccattaagcacttgcttcaagtcaaattgaactttaactccctgtgattgcgcatagctgagtttgctaaatagaatactcttgaccgatttgacctgaacacgacttaaatcttcgagattatactgctcatccgaaacgcgcttggtcactggggcaatattttgttgataatattgctgtaagcctgccaaatcatccgttttcaaatactcattaatcgacaacattatattctgataatcatgacgaaaccggcgcaattcattataatgtgtttcgatttcatgcatgtaccgtgtatcatttttgatttgcaggcgttgttgttgaacctggtacttggcccgaatcgtaacccgatactcatcatagatggcaatcgcgagccccataacgaccaacaacacaactaagttactgacgaccattctcaattcactgtcgaggccctcgctgacaataatgtataaatagatggcgagtagcagcaaggccgtaacccggttcagtctgggacgattgaacgtcgtctggatatgcgtattcattaaaatcagattcaatgtgattaaaccaaccagctgtaatcccataaaaatcaaaagatacccgtcatctaatttcaacatatacgttaaaagtgaactgatatgatcgacgacaattgaccagataatcacctgtaggctaacaaataatgactcactgaagctatgtgtatgccaccaagtaaacagcaccaccagtcccaataatggcaatgctgcatattgcccgattactgaaaaaatccagccgctcactaggctactgaccaccgcataactgatatcccaaatactaagtacccgccaatcacgcaaaagcaccttaacaaacaagaataggaacagcgtttgcacaaaaataatcttcatcagctaccccacaactccagcctactcatcattaacaccactattttgccggcacacctattttgattatgactaatcaatacaaccggttccttcgtttcactgaatcgttttgcccactgtaccatcaaagtcccccttacatattggttgctcaaactggtacctacagtttaaaacactcaccgacacttgaaaagaatacacaatgaaccgaattattcaaccagcctttaagatactaaaccgtcatttcaagacgactaatcgctacatgaacgcaaaaaaagacgcgacctaattgatatccactcgtgcctatcaattaagtcgcgtcttttgtcattaaacctcctaatcttgtttcatcgcgtcccaaatcatttggaaaatatcatcaaatgtatattggtcctgagcataccgtcccttactgatattcgtcgtatgcgtatgaatagttgaaaacacgacccccatatgcaaactaaccggtaactgcttaatcaccttagcatcgatagccgccgttaataagttagcgacaatattattcggatcggcatccgccgccgaaatcgtcatcccctgtccattcaatgccttgatctgttgaatgatcgtcaagctatctggattggctaacgaatagtcatacacctgctgtacatataatcgaatccgagtcgtcacatcgattgttgaatcacttaatcggtctaagtcggtagtactaagaattcggttcgtctcacgcgcatagacactatcgatcagagcctgtttattcttaaagtagagataaacattggattgtgcaatgccgacgcgcttagccaccttagtcgttgaaaccccggctggaccctcagcgagaatgattgccgcaaccgcatcttgaatcttaacttgtttgttcatatcttttttcttcatgtcttcagtataaaagataaaaatatctttttcaagcttgacaaagatagatttatcttttaaactagtaatcgttgaaagatagatttatcttttaaaaataaaaatcaaattttaaagaggttctataattatgaaaattgcaatgttaggttcattaggaaacattaatcggatcgttgttcctaagctcgtccaagccggtcatgacgtcaccgttatctcaactagtcctaagcgccaagcttcaattgaagctgtcggcgcccatgccgccattggtacaatgactgatgttgatttcttatccaccacttttactgacaaagatgtggtttatctcatgctttctggtggtatcggtgatgatcccttcgaaggggccgtggctcaggctaaaatttggaaacaggcaattgaaaatgccggcgtcaccaacgtcgtcaacctcagtagcatcggcgcagatgccgatgaagtggctggctcgctgcatgcttacaacttaattgaacatgaattacgacaacttgacggggttaacctggcttttgtccgtccaaccggattttatgctaacttgttcggtaacttagcaacaatcaaggctgaacataaaatttattccagcacgcctgctgcttcagcacaaaaatacgttgcgcccgaggacattgccagtgtcgtttatcccctaattgatcacacgccagccggtatcaccgtcaagtatgccttcagtgatacgttcaccggtgaccaattcgttgctgatctgcgcgacgccttaaacatgcccgatctacaatgggtacaaatctcagatgaacaatatcaagctaacttgacgaaccacggtgttcccgttaaaattgccgcttcattagtccaaactagtcgttatcagcgcgaacctgaaggactttatgcagacctaaatgcttctgacactagcgctggtcaagtcaaattagctgactttgtccgtacttttgtggtagcgtacaatagtgaaggcggttaccagtcccatacaatcgcagattaaccgtttacaatacctgaacatttataggaggagtttactatggcttatcaaacaattaatccatataccaatgaagttgttaaaacttacgacaacgcaaccactgaccaaatcgaacaggccttaactaccggcgatgccctttatcaccaatggcgtcatgaacccgttagttcccgtgcagccagcctccataagattgccgcactgttacgtgaacataaagatgaattagctaaaattgcaacaatcgacatgggtaaattactgagtgaatctcaaggtgaagtcgaactatgcgccatgattgctgattactatgctgatcacggtgctgaattattggcaccgaccccaatcagcactcaagcaacgggcgatgccgaaattgaaaaacaagcaaccggtgtcctgatgttggtcgaaccttggaacttcccatactaccaaatcatgcgggtcttcgcaccgaactacatggtcggtaatccaatgattttaaagcacgcctctaatacaccgggatcggctgcggccttcgccaagattgtcgaaaaagctggtgctcccgctggtagtctaacaaacctcttcttaaactatgatcaagttagcgatattattgccgacccccgcatccagggcgtcgcactgactggttctaagcgtggtggacaagcggttgccaaagcggccggtgcaaacttgaagaagagttctatggaattaggtggttcggacgctttcgtcgtcttagcggatgctgatattgacgaagcagtcaacttagcatggcgggtccggttatacaacgctgggcaagtctgcacctcatcaaaacgctttattgtcgctgcggatgtgtacgatgatttcttagcaaagttgaaggaacgttttgccaaattagtccctggcgatcctatggacccacaaactaccctggcaccgatgaattccaaacgcgctaaggaaaagctacaagaccaagttgaccgggccattgccggtggtgcaaccgttgcttatggaaacgaaccaatcgacttacctggccaattcttccaaccaaccatcttaacggacatcgatcaagacaaccccctcttttacgaagaaatgttcggtccagttgcccaagtcttcaaagttgattctgaacaagcagctatcgatttagccaacaactctgaactgggcttaggtggcatcgtcttcgccggaactgcggcgcatggcaaagcggttgcccaacaaattgaaactgggatggtcttcgttaacaccttcctcagttccttaccagaactaccatttggtggcgtcaagggctccggctacggtcgcgagttaagcagcctgggcttaatggcctttgttaacgaaaaactggttgtcactgctcagaaacccgactacgacaacggtgctggcggcttagttgttttataaacattagcccctcactacaacaccgattacacgtgcttgaatacgaagcatgtttcaaacttttagtgtcaaaagctaccagcttaggcccactgaaagaagttcgaatcagtataaactttttgtcaagtgcgtctatgccgacttttgtcaaaataagatgaacaggccactaactcaatcacacaacaaaacaggctttgaaatcgcgtcgcttgacgtgatctcaaagcctgttttgttattgcactagtaattggtaactaattgttagccaatcttagcaacgtaatggtaagcaccagagttagataagtacttcagccattgatagccgtccgcagaaaccgtttcgatataataaacggattcgcccgcgtagtattggccaacaactgaggcatttagactagcagcggtccgaatattcgttgtggtcttgaacgtgtacgtaccagcagccgccgtcgtcttacttgctgaagatgacgtggtcgttgcagcaccgccactgaccttaacgtagtgttgcgcaccactgtaactcgtgtaacgtaaccaagtttgaccgttagtcgttactttggcgttgtaattgaccgtattgcctttgtagtaagtcccaacagttgacgcggcgtcacttgctgaagacttgatggcagtcgtcttagcaaacttgtaagtcccgctttgcgcaactgtcttagcactagccgtagccgttgacttgcttgacgtcgtcgttgttgtggctgcaccactaatcttaacgtagtgttgcgcaccactgtaactcaagtaacgaagccaagtttggccgttcttagtgactttggcattgtaataaaccgtatcacccttgtagtaagtccctaaagtcttggctgaatcattaactgaacccttgatggccgtggtgccagtaaacttgtaagtcccagtttcagccttagtgaccgtcttgctagaactagtggctggcttggtggtagtcgttgacgtagctgcaccactgatcttaacgtagtgttgcgcaccactgtaactcaggtaacggagccaagtttcaccattcttagtaaccttggcattgtaataaaccgtgtcacccttgtagtaagtccctaaagtcttagctgagtcactaactgagcccttgatagctgtcgttttagtaaacttgtaagtgccagtttcattcttggtaaccgtcttgctagtgcttgcggcaggcttagtcgtggtcgttttagctgcggcaatcttaacaaaatgttcgctaccactgtaacttaagtaacgtaaccaagtttcaccattagttgtaacttcagcattatagtaaacgcggttacccttgctgtaagttccaacggttttagcactatcactggcagcgctcttgatggctgtgttcttggtaaaggtataccaaccagaggccttcttagtcgttgaactagttgacgtattggtcgtagcactagtgtcagtcgttacttcactagtcgtcgtatcattgctactagttgtcgttacgaatgtattggtcccggcactatcttcagttaaaccattgtaatcgatgctgacatcaatgtaaccggtataatctgaaccagatggtaagagtgccgtatcggagaattgccatgcaccatcattggtgttccaaaggttattagcagaaggtgtgtatgggtattgggcccgccatacacgtgattggccaactgtcttaacaacagcatcccgatataagtatgagttggacgtataaacgccgtgattcttgtaaccaaaggaatctaacgttgaccagaacgcgttcaagttcgccgttgcgttaactgagtatgaagatgaatcttccatgtcagcgaacaagagaactttggttgaaacattgttcttaactaagaaaccagccatgttagtcgcttcagatttagccgcatcagccgtgctaaacgttgcatagtggtagaaatcaacgtttaagccagctttattagccatctttgcttggttcagtgcagctgggttcgcgtaatcagtgccttcagtcgacttaacgatgaccgtcttaacacccgcagcctttaacttattgaaatcagattgcgtcatggtactttgatatgacgccacgtcaacaacatcaacgcgtggccgagtcgtatccccaatcgtccagacatccgttgaagacgtcgttgctgcggtataagcaacggcagcaactttagctgtggctttagtagcggtcgttgccgcgctacttaccgtacttgaagcgggcgtaacagctttgaccgttgcggtacttgaagcagcactggcggcagtactgcttgcggtacgacttacttgagtagtggttgccgtactagaagtgacactggttgcttggcttgtagcctttgcagaagtactagtggctgcactcgaagccgacttagttgcttgactagtcgagctagatgctgtactggtcgattggctagttgccgcactcgacgatgccgtcgctgcttgactggtcgtcttagttgttgccgcactcgttacttgagtcgcagcacttgacgaaactgaggtcgctttagtcgtcgcatcgctagcagcagagctcgttgcaacacttgcactagaggccgtgcttgcagctgaagacgatgttgtcgttgcatttgtagcatcagcgtgcacgtttgtattgttaagaacggaacctcctaaaaatgagaagaaagttaatccagcaaccagccaaagtttccccgacttataaagcttgaatctttccgactgacttgcatcaattggattttgtgatttaaaattcatgtgaacacccttttttaatttacttaaagcagtttaattataagcggttgattgccccgctcgcaaggggatttagtataataattgtacttttcgataaatatttttgataccaacgatatacccggttaatatttcacgcaaatagcggttcaccttaattataattagttgtgagtgaccacttagttcaccaacaattgctaatttgctatgataatatggaaatctgattataaaaatgaagccgttccataattacgcttaggcggaggtcatataataatgaagacttatcaatttgacgcaccgattcaagccgcaacaattggcaaaggtggggcttacgtggcctgtcccttcgatattcgcgaccttttcggtaaggggcgcgtcaaagtccatgccactttcgatgaggtcccttacaacggttctatcgttaatatgggtgttaaaaaccttgatggtagtatttgttatatcttaggtattcgtaaggatattcgtgcaaaactccacaaaagcattggcgatgtcgtcgctgtcaccgtaacggcaatcgattaattcaaatcatcgattccgcgttgtactcgtctatgataacgacccacccccatcccggcggcaatagttggttcatcttataaaacagcccgtatagctggctgtcagctttcaaacagcacgagttaattgaataacaaataatcgcttcaagaatgtcattagaaattcttgaagcgattatttagtaatggtcatcaaaacagcgccgctagttgcttttgactgacaacgtacttttcccatggcgccgtacaaagcccacgctcccgtttagactagcctattcgtcacacagtgaacgttcaatcaaagctggatcaacatgttgatcaccccaggtacaaatcgcatctaggatgggaatcaagctctgccccttagcggtcaaccggtattcgacatgcggctgagcggtcttaaaatcatgccgttcgatcaactcatcttgttccaattccttcaattgactcgccagtgttttatgcgataccgcttgaatatggtgttgcaagtcagcaaaacggctgactttaacctcggtcagttcaaacaaaatcatgattttccacttaccacgaatcaactgcatcgtggcatcaaattcatttcggtagcgtggttgcgcagttacccgttcttttaacattattaactccctgctctcaattggtggttacctaaaagtgcgtacttgtcgcgtttaatctagccaagtatactgtaaatcgttgaaaattcaaacgaaaaccattatccaaaattacggaggaattacaaaatgaaaccattagtcgtcattactggagccagttctggctttggtgccgagattgccaagttattcgccgctgacaactacccactgttactattagggcgtcgccaagcaaagttagccgccttatctgcgaactttgaaaatgccatgatcgacacagtcgatgtgaccaactatcaccaattcgaaactgccgttcgcaaggccgaagccaagtatggcaagaccgacttactagttaataatgcgggattaatgttactaggaaatgttcaaaatcaggacccacaagagtggcaaaccatgcttaatacgaacgtgatgggtgttttaaacggcactcaaattgtcctaaatgacatgcgtgaccgggaacatggaacgattctcaatatgtcatcgttagctggcaagaaaacgttcgtcaatcacgccgcttacgttgcatccaagtttggcgtccacgggctatccgagacactccgtgaagaaaatgcgccgaagaacgtgcgcgtcatgctggtagcccccggtgcagccgaaactgagctgttaacccacgttactagcaaatctgcactgtccgattacgaagcatggaaagcttccatgggtggcctgactttggaccctaagcacgtggctgccacagtcaagttcatgtatgacatgccgcaaaatgtcaatatccgtgaagttgacattgctgccacagcccaagatgcttaacctcagctcatttgattaaaaaagccacctaaccgcaccgggctgccgcgtgcatggctaggtggcttttacaattgctcataagtacccaatcaacacgctaaaatcggcgtttcgacctcctcacaccactaatttaggatcattcttccactgctcatttttgagcctgagtcagtgcctgcatcgttgctgtctgcaaagttgctagtatttcatgaatcgttgttaaggactccaactgtccgccaagtagccattcgcgccaaattgcgtataccccggcactcatgaatcttgtccaatacttaagttgcaccgccgtgagcgtcccatttgccatcgttgtttggtaataattagtcatattagcgttaaaaagttgttgaataatgttttcaaaaccacgttgctcagccagtcgtaacgtcggcgcaaaatcactaaaaaattgacccatcgctaataacttccgattggccggtacatgctgcaagacgtcctgaaaccgcgctgcaatcgccggggcgaagtacgctgtcaaaagatcttcgagtgtcgtaaagttacggtaaaaggccatccggctgaccccagctcgcttgacaacttgggtcaccgtaatcgtatctaaatcatgagtccttaataattgtaataaggccgtagttaaataagtttgtgaatcctttttgattgcttgcgcgtgattggtcgctgccataacaattcctccattctgtcacagatgctcgtgattaccttgtattcgtcgtgaccccattgtaagatactggcacagacgttacaagtgtaacagcaattcataaattcatttggaggtagtcccatgcaaaaacaattagtcgtcgtcactggtggtagcggttttatcgccattcatatcattcgtcaattattacaacaaggctacgccgtccgcacaacggtccgctcattagccaaagcacccgttattaaagaaatgctgaccaatggtggtatcaccgacttatcagctctcgaaattgttgtggccgacctggcgcatgatgaacactggtcggaagcgatggccggagccacttatgcgatcgacgtcgcttccccaaccccaaagctcaacttcaaaaacaaagctgaaatgatccgaccagccgttgacggtgttcggcgggttctaactgctagtcgtgatgcgggcgttaaacgagtcgtgttaacgtctgcgtacggggccatctttgctggtcacaaaaatcgtacgaccccctacactgaagctgactggtctgatctcaactggaaagcgatccatccttatcaagaatccaagacacgtgctgaattagcagcttgggactttattaaccatgagggccgcgggttagaattaacaacggtcaatcccgttgccgtcatgggtccggtgttgtccgccaaatattcacattccaatattcaaatccaacaattcttagaaggccaagttaaagccgttccaaacgttgattccggttatgttgatgttcgtgacgtggctagtctgcacttgcttgccatgaccgcaccgcaagctaacggcgaacgttttctagccacaacgggtgagacgctatccatgcttgacgttgcaaatgtcttaagacaggcctttccagcttttgccagtcagctaccaaccaaaaccatccccaatgcagcagttaagctagccgctaaggcccgaccagaattgcgaatggtcgcctcactagttggcacctacgcggaaacgagcaatcataaaacccaaacattgttggattggcatccccgtcccgctgcggaatcgattattgcaaccgcccaatctatgattgacctaggaatcgtcaccaaaccataagcatactcctactaacaccaactaaatactaaccggcaacgcccgcaagattggactcagtattcaaccttgcgggcgttgtcgttcgttatcattgcgatactagcctaaaccagatatgagcctactttttaatttcatctttatattaaaaatacttgcgtaaatgccacttacgtttagtcgccaaaataacactagcaaatgcgtgaacggggattaggaacaagcccacatcgggattaattaacgcgactgttagaaccactaaaaagccaccaaaaacaacacttaatgccggactactcatacgatgaatgtgtggatttaatcttctaacggcggctactagtaactgataagccaacatccaaacaaaacccgtaagaatataaaatactgcgggccattttgaatgcggaaatttagtaatccatgaggccatgaatggaataaaagactgacatagcaaccagaaactattcgcccaaaaaacaacccgatcgatttttttgacctgcacgaataaatcgtgatgattaagccaaattgaaatcaatagtgtaaatgtaatgatataaacataaatactttgccattccgcaaatagtgcccgcactgaaggagtttgaggccgcggtaagtctaatactaataacgttaaaacaatcgcgataatcgcatctgtaaacgcctctaatcttgccttgttcaaataatcgttcctccttataatctatcattactcaattttatgattaataccgcttaactaccaataaagtcaattctgactttattcagcaattgatcaatacaccaagttataacaaccacaattgcatcacacaaaaaagttctttcgagactagtaaccgtttcgaaagaacctaaacctattatgattaattaatcatcacaaggactattcaaattaaggtaaatcattgcccgatgcaaagtaaacgtcataccattcctggcgtgtcaacgtcacatcggtccccgcaatgctctcatcaaggtgttgcggattcattgaacctaaaatgacctgcatattggccgggtgacgtaaaatccaagccgtcgcaatcgcatttttagtcacatgatattgatcagctaattcctgtaatttcgcattcaattctggaaacttcggattatcaataaaggtcccagcaaacatgccgtattgatagggtgaccaagcttgaatcgtcatgtggtgtagccgcgaatattcgataatttcgccatcatgattaaggctagccgtatcctgcatattcgtgtgcaacccaaactgaattggaccggtgtgcatgacaccaaattgtaattggttgatcatcaatttctggctgactgctgcttgtaacatctcgacttgcatcgggttaaagttggaaacaccgaagtggcgcaccttaccagtagcttgcaattcatcaaacgccgcggcgacttcggcgggatccatcagcggatcgggccggtgtaatagaaacgaatctaggtagtccagctgcatccgttgcaagatcttatcgaccgttgcaatcaaatgctgcttagaaaagtcatagcgttgcccgaagactagttcaccagaactcttctcaggatcaagcacaatgccacctttggattgaataaaaaagtcttcccgctttaaactcgattgttttaatgcctgcccgaaaatccgttccgaatcaccgttaccataaatatccgctgaatcaataaagttaacgtcccggtcatgaacggtctctaagacgttcgctgccgcatcggtatctaaacgaaccatccgcataatacctagcgcaaccgcagacgctttgagctgactagcgccaatttgaattgtcttcataattgttatcccctttttgatgaattatagttaaaaacatctgccaacgagactaataatagttgttagagccgactataagtcaagcggatttaattattttttgctaactgctagaatacactgatagcgtctattttttgctcgttagttaagcgcactgtcagtagcatacagttactgctcaaatttgtaattactagcagaccttgaccgaaccgtcctaaataaataagatacaacggtatctgacattgtaaagacgtatcgttttcaaaaatcattcaatgggctgcttaatgtgactgaatcatgatagtactagtaacgtcatcagcgctaagctcaacgccccactaatttataaaactggtaggcaaccatgacaatcttttctagaaaaacacttttattaaatgttttaaacgaactagccgaaaaactaatctcaaaagcagtgacttagtttttctgaactatgattttcgaaccaagaaattattgatttgatggccgcattttccgaaaagcaactcaagaaagccccagtcactgaccaagaatttgaaaaagtagtggcggtagctaagccagatgtacaaggtattcactccgtttgtcaacaattagtcatcagttttattgctgaagaacgcttcttagcagtatttggcgatggcacatgccatccttcaaactagccgcttaattaaacagaaccggttttaactgttctttgtactagtccctgccaagttatcagattaccattgacaagtctttaaactagccgaatttaacatagtatcgttcgaacaacttctatattaaagcgtcggattagcagaagtgaaaagcatctctaactaataaaatcttaaaaattaaagcgcgtaacattaaattgtcacgcgctagcttgtactagatttacacatgcacaatcattatttgaacttgttccagacacattcaataactagaataatcccgaaaaaagtaaaagttcctaaaaagtaatgtatcaacgttgttaaataagcaaaccaatcgtatggtagctggttataacgatcgatactacctttcactacaaatagtaaaacaaactcaagcatcaacataatcttattaatattgataaaactatcaacttgtttttgatatcgtaaatagacctttttcaatcttatccccccaaaaagtattgcctcgcaagatgtgtttaataccatcatatcaatgaactgctgcgcctgtcactgttatcttgaagttatgattattaatctcaaaagcttatacagttgggtccttcaattctataaggaatattaacgaattaagccagtgccacaaaaacgcacttaggtaatcgagatgccctgtcgcaatcaatcgttgcttaaccagttcgtagtaagcagctctgaacgggccgcgaatttttagtctgttacttaatacaggcccgaaaacggcttggctgattaacaataaatgaaattctccatgggttacttcgccgccttcaatttgttagtcagcaataaggttggcaaaataataactattgcggcaattgcaatcactagaaagccttgttgaaacgctgctaagcgaattgcttgcaaatggcttgttgtaaagacttgtaagtgagctgcgtcgacgtgatacgttcctgcttttaggtgtcgttcaaacacattcacttggtgtgtggaatacgccgttacaatcgtcgtaatcaaagcggatccaaacgcacttccaatattttggataattctggtcccaattgttgcagctggcacttgtccaggttgcattcctgtataagcatcggccattaacggcattaaaataccaccagcaccaattccccgcacaaataaaacaagtgccaaaatccagtaagacgtctgttgaccaaaccaataaaacggtaaggtaccgacaaacgtgatgacgacacttcccagaaccacgtacttagcgcctatttgatctgttagccttcccgttaacgtccgcgaaactagcattcccgctccctgaggtaatagcgctagagcggcgttaatcacgctcattccccgaacgttttgaaaatagagtggtagtaacaacattgcgccgttcaataccgtcccagcgataaacaatcctaagccagcaccatcaaatgatgcaaacttaaataagtgcagtggcactaccgcccgttctttttgccaagcggcccatacgacataactaatcaacgctatcgcccctagaattaacatctcaatacttgtcgcgttattaaaacggtcagtatgcgcggcattaaccaaactataaatgatagcacttgaggacacaattagtagcaagataccaataaagtccattttcgctgttcgattttgtgccggataattcggcatcttccacaaaatcaaagcgattgaaatcaagactactgggacattgatccaaaaaatccaatgccacgatgcaaatttgataatgattccaccaatgaccggtccgattaatggtcctaaaatcatgggtagcccaactgttgccatcatctggcccatcactgctgcacccgcagtttgcacaagcaaggtcgtcaagattggcataatcaagccacccgcaaaaccttgaactaaccgagcgataatcaataattgaatattcggtgctacggctgcaaatatcgagccaagaccaaacaaaatctcaccagccacaaagaccgctttaccatcaaaacgattgagtaaccaactggaaaatggcaccgcgacccccgttgccagtaaataacctgtaactgcccactggaccgtcgtcacgctactatgaaaactagtcactaagttgttaatggcaatgttgatcatggttgaatctaataatggtgccatcgcaccaaacactacgacccaggcaatcgtcatagttgcttttgaaatttttgcttttgcttgcatattatcctcctaattaagaaacttaaagtgtcttactcgcataactggtataatacgctatataaagaaaaagtcaataagaaacttaaagtatcttatttaaaaaagagggattacatgactaaaacacgtcgtcgtggcgctgaactcgaaaacgccatctatcaagccgcccgtgacatcttaaatcaagatggtcttgaacaattgacgttcgctaacgtcgcggaacaggccggcaccagtaagcctgtcatttaccgacgctggcgttcaccactagagcttgcaattgcggctatccaggaccaaatcattacggaaaaccatggtcaactagacgaagtgagcttgaccggtcagacactttctgaagatttattccaagtactcaagcgcttcactgtcagtattaatacattcaatcaagctttggttatcacttggtttcaccacctagatcaacaagcaaatccagaagttaaggacttgctcaatgctgtgaaaaagattgacgcccatgcgattgaacgcgtgtgtcagcgtgcacagcaacgtggggaactgcgtacggggactttatcgtgcgacttacaactgatgccattcgactggcttcgctaccgtgcttttgctaatgaaccgattactgatgccacccttcatctacttgtcgatgatttattagtccccgcctatcaacacgcgttgggatgatgattaccgctgtctatagacaataaaacgcgtaaattacttattttactgtgagtaatttacgcgttttaaatttttatctcaatcctattatttttcgttataatgattgactaactattatttcaacaagtctgtcttcaccatatcaatcatttgtgaataagcaattggtcccgaatactgccaactgctactgtcaccatactggtacagatggttgtttttcacggccttgatatttttccacagcgggtccttaaatagcgacgcactcttttgactattcactaagaaaatatcatctgcatctaacttagcgagcttttctaacgagaccgccgaccaatccgccgtggccgacttagacacttgtttaactaaacttggttcacccaattgtaaatcttgatacagtaaggccccactggctgaattgtcattgaccatgtaggcggtattattggtgacccacaacaccgccactttatgctgaccagactttttcaacgcttgtcgcgtcgtttggacctgtttgtcatacttagcaaggacttttttggccttagcctggcgattaaccaccttagccacatcaaggaaagtttggcgccacgttaccgtagtcccatttttgaccacgtaggtcggggcgattttattatattgcgcatacttgccattggcgactgcactactcgtcccaatcagaatcaagtccggtttggccttggtcaccgcttcatatggtaacgaatagtcaattagcggcacccctttcaactgctctttcaagtaagcctgcgtaccactaccatttttgaccgaccactgcacgaccggtttaatgcctaaagccactaaatcatcttccaaataactcgccacgatccgtttcggatgcttcggcaccttgaccttatgcttcaaataatcggttcgtgtaactgtcgtacttgtcggctgcttcgcaccgcacgcccctaatagtaggcttcccattaaccccaatactaatcccaattttacaatttgccaccgttttgtcacaactgtctccacctttcaagcgctaccaaaattattagtgaaaacactatcaattgtcaataaaaacatttaagataagactatcaattgaacactaattattagttagcagttgttttaatcacgttttccaacaaacaagctggcaaaataagattgtgcacaactaaacaaaattagttaacttattaagcgaacctccttgaacgcttaactttaagaaaggaatcctatttgtgaataccattgaagcccaaaatattagtattggttatggcgacaaggttatcgtcgatcagctatcaattacgattccgcatggtcagatcactacgctgattggcccgaatggtagcggtaaatcgaccctcattcgtgccatcgcccacctattgccaccaacaaccggcgttattctactggatcatcaaaacattcaacaaatcaaaagcaaaacttttgcgaaaaagattgcagtcttaccacagacgaaccaaacggctaacgatctcaccgtagaagaactggtgagttttggccgcttaccttatcggcggccgttaagtgggctcaccacaactgaccatcaaaaaatcgaatgggcgctcactcaggccagcctccaagatttacgccaacggcccctaagaacgtgtttagaatcttttcaagagtattcgcaggaaggctaagctaatcatcatcttactggtgttcagctttcgctcacaattgcgccagaggcgccgatattttcctagccagctaaaactgcgttcgataacccagcgttgcggggtcacttgaccgtgcctaaggtcactctgtttagcaataatgacttcagcgttaatcattgcctgaactgattgagcaaagttgttaccagtataaccaccatcggccattactcgttgaaccaggtcaaactgtgatttgtttaacgccagtagcgcattggcgccatcacgctcagaaacattggcggttgtcacatggactgccatcggcagcccattgatatctacagcaagatggcgcttaatcccactcacctttttaccaccatcgtagccgctactttcagcaggatcggtattcttgacactttgagcatctagaatgacgaacgatgtataaactgaacgcttctgagccaaccgatgttggctgacaatttttttaaaaccttatccagaggagtgataccagcaggagatggcgttttagtccaaagtaaccaataataatagacggtttcccatttaggaaaatcgctgggtaaatcgcgccaaacgcacccatttttcaaggtataaagcagggcacaaaagatatcatataaatcaacctttcttggcttagtccgcttacgtatgccttctagatctgtccggattagttcaaattgttcacgagagatgtcgctactataatggtgtgcaaagcttttcatggattaaaaacccctgtttttgatctaatttaactaaaatcaaatcgaatgtcaaagtatccaaacacgttctaagcaccctttctggcggacaacgtcaacgggcatggatcgccatggccgttgctcaagatactgacacgattattctggatgaacccaccacctacttagatttgactcaccaattagaagtgatgcaactcgtcaaaaagctcaacgaacaggcccaccgaactatcattatggcattacacgacttgaaccatgcggctcgcatctctgaccaattaatcgcgctcaaggacggtcacgttttggcccacggtcccgtgtccaccgtcatgacggccgctaacttaaaaacaattttcaatattgatgccaccctcgttgactaccacggtaccccactgattttgacctataacggctgtcaggaagtggcccccgcatgaagtcaacgtccagatattgggggtggctggcacttagtaccggcgtactcattctcgtcatggggctcagtttgcaatttggcgctgaccagatgcgtacggccaccgtctggcacgccctgacgaccacacacactggcaatcttgatcaacaaattatccggcacattcgtgtgccccgcgtccttggagcggcattgattggggcagctcttgctggtagcggcgccctaatgcaagcagtgacgcgtaacccgttagcggattcaggcttactggggattaacgcgggagcgggcttaatgctaacgctgtgtttagccttttttccaaagttatcaactttacaaacgactggttgggccattattggtgcggcagccagtgccggactaattttcagtatcagcaccgcccgccatgttcaactcgatcccacgattctggtactcgctgggattgcaatcagtagcctattaacagctctgagcgaagggctggcccttgtgttgcagctcaaacaggacctcgcgttctggtatttcggtggcctgggtgccgtcagctggacacaattaaagtttctcggtccaggactagtcttgggattgctactgaccctactactcgcaccgcaactaaacttagcctatcttactgacgacaatgcacagagtttagggaaaagtctcccattactgcgaggcctagctctcatctgtgccgtcattttatccgggatctcagtggcattagttggcacgattacttttgttggcctgatgattccccacatggcgcgttggttagtgggcgctaattaccgcaatagcatgccattaacgttgatccttggtgcaacactgacggtcggtgcggatttgattgcacggctagttaatccgccacatgaaacgccctttggcatcattatctccttaatcggggtaccgtgcttcatctaccttgcacgaaaggagccgatgaaagcatgagccctaatcgtcgcttaattatttggtcactgctcttaactgctagcatgctcggactagcgattctcaaccttagtacgggtacaatgaccatcagctggcccgctctgctgggaattttaactggtcgcggtaatgcgaccgacatgctagtcttagtcaactttcgcttaccacggatcgtgctcgctatcatggttggctgggccctggcattatccggtaacgtcttacaaacggtcaccaacaatccaatggccgaccctagtctactcggaattaataacggcgctggactagccgttatgttactcattattggtgcaggcaccaacgcttcgttaacgctgagtttacctatcgttgcgttagctggggcgtggttaagtacggccctgatttttttattagcgaatcagcgtcaacgagggatctcgtctaagcgcctgttactggtcggcgtcgccttgttcggctgtttttcagccttaatggtgttgatgacactaaaattatcacctgataactatcaatttgtcatgaattggttggccggtagtttgtggggcactgattggtcttatatcggctgggcgcttccatggctggcagtcggtagtggtattctattcattcaattacccgttctcgacgcttttacactcggtacgaccactgcccaaacattgggaatcaacttgaaacgccaacaattgggattgattagcgtggccgccatgttagccggcgtcagtgtcgccattagtggcggtatcagtttcattggcctgattacccccaacctggcacgacgaatcgtggggtcccgacaacgctatcagctgccgttagctggtctgttagggagtacgttattactcgctgccgataccttaggaaaactaatcaccacgaccactgaactgccagccggcgtgctcgtcgcattgattggagcgccatattttatttacctgttagtgcggagataaataaaccttaaaacgagtgcaatcgtgtcgtatgcatgaacataccaactattgcactcgtttttttacgattaatcattaaaatatttggttggcttaccaattctagtcccttgactataccgccgcagggcacatgcttataagcgctctgaatttcaaatgcttacaccacatctttgtatcggcacaccggacaggttatactaatcgtattctattaaatttcgaggaggtattcgtaatggctaatcaaagaaatcaacggatgcaggccacgattctactggcatatgaaaacctgctgagtgacaagccctttcgaaaaatcaccgttcaagatatttcggatgcagcgttagtccatcggtcaactttttacaagcactttcaagatcagtacgatttattggaagccctatttgaacaaaagcggcagcaatcgaagctaactattgaccagatcttcacacatccttttgaaacgctcaactcattcggcaatgcgcgttttcaagaaacattgcgtcatcaatttaacgatgacgcctttcgcgatgcattcctgaattatctaatccatctgtgtaaagatactgttgacgatgatcaacgactagtccggtttctagctgttggccgtatcaagggactcaccttatggataaccgtgggcaatgcgccttataatatattcacggatacggctaccttggacaatatttttagtaacccacttaataccgtgaactactaatatcagttaataaatctggttgtactggaacccaacctaatatttgtcgtgtaagctgactggaggtcggacaattgattaggtaaagcatcgctgtgtcgccaaaactcagtggattatacttagcctttaatggaacatttaacttacgactaatcgtacgtgcaatggccgcggttgtgatcgattcctcggcaactgcgttgaaaacgcgctcgttagttgttggatgctcaaggccatacatcgtgactaaataaaacaagtgcgccgcatctaaccgatgaacagcactccaagcatgtgttcctaagccaaagtactcagcacggtggctttttttagcacgctcaatcactgttctagtaaagcccttatcacccgcaccatgaacagccggtgataagcgtacgacaaacgcattgatgttttgagccattaactgacgtgcgacgatctcagattttctcggtgtgagccatttgagtagcccagtatccgcgacttcatgctccgtctcgacatgctttctaatacccgtcgtcccatacgtaacgaccaacggcttattagtcccactaatggcacgccccatagtttcaatggcacgccgatccattgcaccagcctgaaaaaaatgccgaaaatcattgttaaagcccaaatgaataatggcatctgcctgagcagcagccgtcgccaacgttgacaaactagtcaaacttccgcgtacaggctgagctccccaactaatgagtttttgagcgctcgtctcagaacgagctagtccgacgacctcaaaaccattagcgactaattcttgtacaaccgcactacctacaaatcccgtaccacctgttataaacactttcatcaataaccatctccgctcatctacactattttaattaatcctcaatattcaatacttgtgacacacctaattcgaggctttcgttgccttctatcttaacgatgatcacagcgcaaagacagcaacaaagtatccatactattcacgatagcgacacttgtctaaaaatgtcgttgtatttaacgttattatccactccacatgtagacttatctaatcagtagcacctatcaaaatagtcgcgacctatcttacagataagccgcgactatttaaatcacttgatttaatgattaaacttcctgttgtgctggccgtactaacacttcactaatggcgacgtgtttaggctgatcgatcgcaaataataccgcgttagcaatatcttccggatttaaagccaatccttgacgatcgtccgcattcatcagctcactgataccggcctgaatttgcgtattgccgattgtattgaccaactccgtccgaactgcacctggcgacacgatggttgaacgaattccgtgttccttttcttcctgtcgcaagccttccataatggcccggaccgcatacttagtcccgttatacaccgctgatgcgggataaacaacgtgtccggcaactgaatccgttgcgataatcaaaccatcatgttgcttttgcatgattggcaatacttcaccaattccattcaaaacccccataatattcacgttcaacatcatctgccacttatcgtattcacggtcactcagattaccctggggcatcgtaccggcattattatatagcacatcgacacgcccaaacttggaaacggccaagtcaatcaaagcgcgaacttgttgccgatctgttacatcagttacttgatagaccgcgttgtcaccaatcgcttgactcaaggcctgtaaccgctcttctcgacgcgcccccaatacaactttagcgcctttagccgctaacaacttggccgtggcggcaccaataccgctggacgcacccgtaataacaaccactttacctttaatactcatctttataaaacctccgttaatctacttgctcaattgttttaatcactttagcagggacgccggccaccaccgtatttgctggcactgattttgtcacaactgcgccggcacccacaacagcattttcaccaactgtgacgccagctaataccttggcaccagcaccaatccaggcatttcgttcaatgtgaattggctgaacttcaaccgcatgccgcttagcaggatctaacgggtgattaacggatagtaacatcgcacccggaccaatcagcacgtcatccgctaattcaatcccgcctaaatcagtgatctgaacattatcattaataaaaacacgtttgccgatttttaaattccgcccatagtctgtccacagtggcacgcgaatctcgactgaaatatcgatagtttgacccgttatctccgcaagacgttcacgaatttcacttggttcccgggttacattcaacgcttgaacgcggcgctgattagcatcgacaattggctgaatggtttgcagataatcttgatctaaatactttgctttgatgatgcgtccctcccttattaagttaaattcagtatacgagcgttcactatacatgtgaaatgcttatgttaaatacacattcataggtttaaagcatagaaggactctgctgattatgttctaaatcgccaataactactgcacgtcataattaatttaatgcttgctatcgggtcgaccccatagtttatacttgcgcataatcatcgaattgaaggagtgactgacatgcaatcaaaattagctgttattattggtgggacttctggcgttggtaaacacaccgcaattgaccttgccaaccaaaactatcatgtgattatcgttggcggtcgggctgacaaaggacgacaggctcaagccgatattagtcaagcaactggcaatcaggctgtccaattggctttggccgatctgagtaccaaaactggtgttcaacaatttgctcatcagcttgcagctatgactgatcacatcgatattctactcaatagtattggtgtgatgctacctgagcgacatttatcggcagatggttatgatttgaacctagttttaaattacctcacccatttttggatcattcaagccttattaccgttgctaaagcacagtgatcaggcgcgcattctattggttggtgccctgccattcgtgattaaccatgctaaagttagtcttccagactttgacgccccggccacatccaagtacaatgccatgaccgtcacggcccaggccactgctgcgcgcgtactactcacgttagctctcagtgaacgcttaacagcaaccaacgtgacaatcaacattttccaccccggctatgtcccagattctaactttggtgctggcggtagttgggtgagtcgtttggctggtcggatactgggtgaaagtttctctcgtaaaaattccccgattggtgcatggttagctactgctcccgaactcactcacacaagtggacacttctacgatgaccgcctacgtcaagttccgttatctaagcagtacactcgctctaaggccaacgacttatggcgactcagttctcaatattaaggagacgctcttgttaacgtttaaaattcctgagcaacagcattacttcactactaaggaagtcaccatgattactggaatgactaaagatgcgttacgatattacgagcaccttggcattctgcctgatgttcagcgaaaccaatacaattaccgtcaatattcccacaaaaacttggaaacactccaactcattaaaatatttcgggacttagatctcgatttaagtctattgacaccagcccatctagcactagatggtcaagcaaaagtagtcgctttcaatcagtaccaacaagtcattcgggatcgcatccggcatctggaagcaatcgatcagttattggcaactaaaatcgactactttgaacatcaatccattgatacttaaacacaacaaaaaacacttaacaaaccctattcccattgacttttcgccaatgctaggatgttaagcgttttttgttatgcacagttaaataaattcattacttttcatgccgcttacgcttcaaaccaccaaagcctagcaataatgttgctagtgttagccctagtgtttcagcagctgcttcagaccgtcgcgtttcaccggtctgtggcaatcgactcgttgtatctgcttgagccttgtgagccggctccgttactttacttcccggcttgatgattgctgatgccggagctgttttgacagccttaatgcgactcgataccaacgtccttgtcgatttagctggcgtctggttgccagttgtggcttgaacagccttcacaaccgttgatggcttagtgagttgcgttggtttagcagccgtgattggtttcgtcgttggcttgattaaatcgtctgatgttgtcggcttagttggtttgaccggtttcgtcggtgttgggacgtccagcgcatatgttagcgtttggacatcatcagcactagcagccgtgattgtcacggcctgagaacgtgtttggatactttgacattcgatttgattttagttaaattagatcaaaaacaggagtttttaatccatgaaaagctttgcacaccattatagtagcgacatctctcgtgaacaatttgaactaatccggacagatctagaaggcatacgtaagcggactaagccaagaaaggttgatttatatgatatcttttgtgccctgctttataccttgaaaaatgggtgcgtttggcgcgatttacccagtgattttcctaaatgggaaaccgtctattattactggttactttggactaaaacgccatctcctgctggtatcactcctctggataaggttttaaaaaaattgtcagccaacatcggttggctcagaagcgttcagtttatacatcgttcatcattctagatgctcaaagtgtcaagaataccgatcctgctgaaagtagtggctacgatggtggtaaaaaggtgagtgggattaagcgccatcttgctgtagatatcaatgggctgccgatggcagtccatgtgacaaccgccaatgtttctgagcgtgatggcgccaatgcgctactggcgttaaacaaatcacaatttgacctggttcaacgagtaatggccgatggtggttatactggtaacaactttgctcaatcagttcaggcaatgattaacgctgaagtcattattgctaaacagagtgaccttaggcacggtcaaatgaccccgcaacgctgggttatcgaacgcagttttagctggctaggaaaatatcggcgcctctggcgcaattgtgagcgaaagctgaacaccagtaagatgatgattagcttagccttcctgcgaatactcttgaaaagattctaaacacgttcttagtattgcaattgtcttagataaatacatttaaattaaatagacacagcaaaaaagcactcgaaattttggttctataatatttggtactgatagaaaaatcttctctcagtaccaattttgttttatgatgatgaatttacactttaagtgcaacactaaaacaaaataaaggactcacaaagaaaatccaaatataataagtttgtctataacttaaaaaaaggaggatttctattatgagccactatcaacatcttactataaatgaccgtgaaatgatattggagggtcttgcacaatgtaaaactattcgtgagatagcccgaaaattaaaacgtgctccttctacaatttctcgtgaaattaaacggcataagagtgtaaatactggaagatactcaccagataaagcccagaatgattataaattttctaaaagcaaatgtggtcgcaaagcaaggctcatggaagatccatccttgtttcaaaaaatcaaacatcttttcttagattgtcagtggtcaccagaagagatttcacaacgcttattgcttgaaacaggcaaaacaagcataagtttcattaccatttatcgtgggatttatgcaggtttatttgataaatctggcctaagccaaggaaatcgtggcgctattcgtaaattacgtcatcgaggtaagcctcgtcacaataagaagtatgtcgaaaaacgtggtaaaattccaatcactaatactattcatgaacgtcctgaagctgccaataaaagaactgaacttggtcattgggaagctgataccgtggcaggaaaaacaggacaatcttgtttagtaacccttgttgatcgtaaatcacgctttttaattgctagtaaagcaactaaaaaagttcagaaccggtgacaaccgagttgatggcaatgtttgaaaaaattggcaaaagcaagcttaaaaccattacaccagatcgcggtaaagagttttcgaaacatgttcagctgacagatttgcttggtattccattttattttccagatccacatgcaccatggcaacgtgggtcaaatgaaaataccaatggactcttacgtgaatactcacctaaagggcaaagcctagataacaagacaaacgatgaaatccaggaaatagtcaacaaattaaattttcgtccaaaaaaatgattggattggcgcacaccatatgaggtctattttgataaggtgttgcacttaatttgacaattcaagatacaaaaaaatgtagaaagaccgacatttttgattgccgttttcctacattttatagctgccttttacatcaagtttaataatttatttcatcagtaccacttgataaagaacctaaagttttggtggaaaccaagcctgcagagacaaaactcaacttttaataaaaatagcagcacactcagcccgtccttgcaggcaaacattgcagggatactgaggtgttgctatttttattattctaattcaaaaaattcattgactttactcctggttaacagtttctcgggttttccgaccattaaaccagtcgagtctaagagccagaccacatcggcaaatgaccgtgcaataataggatcatgaatactgagcaaaaaagtctttccaaactcctcttttaacttaaccaacaagttaagcaatcgttgttggtattttagatccagaaaagccaatggctcatctaaaagcgcaatgtctttatcttgtaaaagtgtgtacgccagccagactcgttgttgctgtccacttgaaagacttaaaacttctctatttaataagtcattcaagtctaaatccgtgttgatcaaggagatatcagtactatacttactgcttttcttacccattgccaggagatcttcgacctttaaatagtcaaagatctcatttttttgtggcaaataaatcatactttcagctctgtcatactcgccccgtgctttttttaatccgctcaaaacttccattagtgtagatttgcctgcgccattttgtcctaacagcattgtgatttgctgaggctcaattctgcccgataaaccacgcaaaacaatttttccatggtagtcagcttggatatttttaaacttcacgtgaccacctcattatcaaaaataagatcagcggagcagtcaaaagcatcagcagcgcatttgtcggcaattcctgggacggtatcaaataatgagctaagtcatcagcacagactaaaacacatccgcccgttaatattgttaaaaatattcgctgtcctgcaacaactttagtgctcaacttgactacttgaaccaacactatgcctacgaaaaaaactgtccctaaaactgcacttaccgctcccagccacattccagccactagctgaaagaccaacgaacttttttgctcgttaaatcccagctgctgagcttgcaagctgggtaaaacaaagcctttgaactgttcccactgccacagcagcaaaagtagaccgctaagtaaaatgatcactaaaaaccaaagatctgtccaagtagtattggataagcttttaccctgaaaaccactgcccgtggtgatcagctgtgttgcagccacaaataaaagcgcgagactcaatccgccaaggatcaagaaaaatgaactgcgtttaactttaaaaagagtggttcgtaaaatgactaatagcaagccgccagtcaatgctcctattaaaacacggtaagaaagaagctgagaaaacaaaagattaactaatgcaatgacaagctctgccccactggcaagtcccagcatagagccatcaatataatcagaacgtaaagttgtttgatataataaagcactaactgttaacattgagccgccaaacagtgcaaagatcacgcgcggcaaacgtaactgaataatagtttgcttccccgctgtctgcccatgaataaatagaccgagccctactaaaagcaaagcagcgatactaaatattatttcaagctgtttaattttcttggctgtcatctaaccactcttttacttcttgataagcttctttcacgtgtaaatttgccgttggtgaaaatttaggtgcctgaacatcgtgaacctgtttttccctaacagcagtcaaattaggatacggcatgcttttaaaactttcgttaaaggatttttggacctgttgcggcatcgcatgagccagcctaatgatcacatctggatctgcttgggcgatcttttcattatcaactggagtcatcattgatttctggtctgcagcaacgatctggccgccagcgcgtgtgaccagatctccaagatagctgtccttattcataactaaaaaactgccaccgggcatccccattaaaagtaagaccttaggcttcttttttcgctgaacatttttgatcttcaactgttgatttaagtttttcgcttgtttttggcgactatacttgttgccgatctcggtgatagtctttctcattgcgggataatcactaaaatttaaggaagacatcttgatgccttgttcttttaatttgcccgcataatcttcagttaattcagagtcaacataaaccctatcaggttttaacgaaattattttttccatatcaacggagacatggttgccaacatgaggcagcttctgttcttttgccggtaacttttcgtttgttgtaggcactccaactaatgggatatcaagtttagcaaagatctgtgtcatcgggacggtcgttgttacgatccgctcatcgatcattttttccttgctttctttttccgtctgctggttccaaaaaaaccaaccaccaattattactaataaaaggagcactgctaccagcgcaatggtcacatttttttattttttatactcatttttaacgaagtacacgacccctccaatgactataactacgaccacaccgccgatccaccaagcagtagatgaactagcatggctctcttgcttagctttaggctgatcgtctttcttagattctttttttgaactttcttgtttcttgcttgcctttttacttgagcttgtctctttcttctcactgcttgatgaagaagacgaggaaccgctgttagaaactgcagaagaagcacttgagctttttgaagacgctgaacttgaactagacgaatttgctgttgcagtcgtgtttttagtcgtttgacctgaagcatctttttgagaagcttgttgtgcctgcgtttgttgactattcaaggcaggcacatttcctgcgtccattctcaaattaaaaccataaacatggtggtaattgatattattgatatcaaccttcatattaccactcattacttgtttgacactcttagtgttaaacgtaaaaacgtagttatctctgttaccagaagttgatttactgatctgtggtgtctgaccattaacgttcaaaatttgaaccggaaaggatcctagtgaatgatcagttgaaacggtaatagaaacattatatgaatcaccattcacgctaacagaagctggtttagaaaaataagcgtctgcataggaagtttgacctgtaccagcctttaaaatcgtataattagtttgataattatctgcatggactaattgtccgtgacccaagccaaccaatgcaaaaaataggacgctcagaaaagttaaaactgctctcttcttacgcattttgcttcctccgatagatatcaaaacctataataccgctgatcaatacgacaaacataacaacaccaacagtcaatacattattatcctgatggtctttttcaccagtttgcggtaataaagctggatcagcagaaacaggcataccatcaacagtttgcggtaataaagctggattagcagaaacaggcataccatcaacaggaacaccatcttgtccttggtcatatcctactggggtactggtaacttgacctgattcaccgttattagctgcaggatctgaagcaggtgtttctttaggatctccagttgtaatggaattgatcacaaccaaagcagtaacatcatgagaaaacaatcctgggactgtatatttcatagaaaccaaaatcttgttaccaaccttcaaatcttttgccttagaagcgggtagcgtgaccgtccaataaccgctgttatcgctttgcttgtgttcctgcattgtaaccccatcaaaggaaagggagctcatataactcaacattttcggttgttgaatagtaacggtaaccgttccatcattatttttaactaatttgatacttctgctccataaattatcactttgaatcatggatggttggcctgtatcagagttatttgcacccgttttattgtaagaaacttgggcagtataactgccaatatcagtcaatgaattaacagaatgagaagccagagaatcattctttgactgcttattattttcattttgagtacctggctggttatccttagatttaggtgctggcttaactggcgtaccaatatcagtcaatgaattaacagaatgagaagccagagaatcattctttgactgcttattattttcattttgagtacctggctggttatccttaggtttaggtgctggcttaactggcgtaccaaaaccatccggactaatcgacttaatattagctatagcatcatgagttgaaacactactacctaaattataactcacaccgatcttgatctgtttaccagcaacaagatctgcggccttaccccggtagttcagtgtccattcattggctaccttagtcattttttgcccattgaatgtcactgaattcatcatgtccattaacttgctttgtggaattttaacggttacattaccccttatatccttaacgtaagtaattttattgccaaaaaagttatttaaaactgagtcatcgtttgtacctggcttagtataattcactgttgcagtatatgtctgactttttggagcaggttgacctgaatttgtcgctgatgagctttgttgatttttttgtaaatcagtaacagcattctgtaaatctatgacttgttgttttaatttattaacttctgactgcaactttttattttgagtgttagcattctgtaagctattagcaagagttacattttgtgctgacaaagcagtaacatcttcttgtaatttactaagttgcgagttatttttgatttgctcttgtaaaatgttgagttgcttttgtaactgctgattttgttgctgcaacttctgattttgctcataagctacacgatcaggttcatcgattgaatcgatctgcatcaatacatcgacattatgcgtaaataaacccggaacagtgtactgcatactaatcgtaatatcggcacccgtctttaattctgtcgcctgattcctagtaagacgcgctttccatgaaccagtatcgtcaccattatcaactttttgtgtatctacaggttgagctttagaattttgacccacatacttgacataagccatatagttcatcattttgtcttgtttaatcgttaaatctgctgaaccattagctgccaccgtatatttaacgtttttatcccataaacctcccgtttcaatcatcgaatcttcagtgggcttatcggcatttttgtatgtaacatgtgctgtatactgaccaggtatctgatcatttgttgtgtctgccttcacagattgaacgttgaacccaacgatcaatgaaaacaaaaacgtgacaactaataaaagcttcttactaaaattaatttgattcaatttatcttcctcctgcctcataaattatactgttcacagcaaatattaaccgtttacccttaataaatcaaattaaacttaacatatttttacaaacagggaaagaataacagatggcggtttttcattatcttgaatatgaacaagcttattctgggaaagtccgaatgctgggctattgaatagaaaccagttaaggcagtggtgtataggttctttttggacgcttaaaaaatgaactgttttatatggagtattctggaaggatattagtatagacccagtgagcagtatttttgacgctgagttgtttaaatagtacgtttttattagtagaaataaaacaaataggagatgaaataatgaaacaagtaccagaaacaaaaatcaaactaacggatgtaaaggagttgattaataaagggtataaccttttaggtgagcttcgtgaagaagcagatgctccagtagcaaaagcagaatttctgacagaagaaattacaaccgtttatggagaagaagcagcgcgtaaattttataatcctgaaaacttcaagcgggaagggtctatgccaaaagcagtattgaaaactttatttggtgaagacggcgtacagacgatagatggaaagaaacaccatcaacgtaaaaattatttcatggatttgatgactccagaacgtatggaagactatagagctattctagatcaaaatcttgcaaccgaactcgatcagcaacatggcacttttgagttattcgacctttctaaaagagttctctttaactctatttgtgaatgggctggaattaatctagcacagtatgatccgaaagaaatcgataagcttgctagtaatcaaatatccatgattagcggagccatcacttctccaacggaccacttgaaagcagtaaaagaccgtaacgaatcagagggatgggctcaatcattaattaaagaagctcgcaaaaatcctgtaccaggcaaagaaaatcttgccctctatacattcgcacaagcagaagacctagaaggagagttattaccagtagaggttgcagcagttgaattgctaaacatcattcgtcctactgtagcactgacggtttggatggccttaatggggcatgcgcttttcagtaaaacgaacttgtatgaccaattaaaagaagactttgataccctacaagattcctttattcaagaaatgcgtcgctactatccattctttcctatgttaccagcaatcgctcttcgtgatgtagaaattgatggttacgaaataccaaaagatagctgggttgtcttagatatttatggtacaaaccatgacgctcgtacgattgatcatccagaaaaatttgatatcaaaagatatattggaaaaacaaaagaaatttcttatgaagaagaatacgaaatgattgcgcaaggtggaggaaaatttagaaatatgcaccgttgtgcaggagaatggattactcttcacagtatgcgtgtcttttctgaccaattagtaaataaatataactttagtattcccgaacaagactggaccgttccaatgaaccaatttcctacgtatccaaatagtaaagcattgttgtttaaagaatgatttaaaaataaaagtttggtagagagctcccgataaaatggtacccatgtcaaggacacaataaaacaagagattaagctgcttgaagatgcctcctatattgaataggggtcatcttttttaaattccattgataacggtaattgttagagtaacgtaagcgcctaatagaaaggtacctagaaaatgaaaaaggacacctctttttgggtctatttttataaaataacccctcaaaaacattgaaagaataacccccaaaatctataatatagatcttgggggttatttgttttaatattaaagaaatgacttcttctatttgtcatcaatactaaacaataatttgtacaaagtgattatttcttctagttcttcacgcgatacatgatcgacaatagtttcatcagtgacatgtcttgcccgtaaatctaaggctatggtttgatctaataatacttttccatatactgtttgactactagttagtcgatgatacattggaaaattacgcttggtactgctaattggcgccacaatcgtcatgttacttgtctgacagactagatcattgcttagagcaatggctggtcgcttattcatctgttcatgaccacggcttggattaaagttaacataaaatatatcaccttggcttaccattgaagttcattaccttctgactttccccaatcaagctcgtgatcccttttcccgtcatctttccaatccttaaatagttcgtgaatattggttgggttcttttttattggtgttaaaacaattgatccattttcaatggttattgtcatatcttggttatcatctaatttcagttgtttaataatttggctaggaattctagcagctttcgagtttccccactttgccaagcgtgtttgttctttaataagttccatatttccccctcctaaattattattacaagtcaagtatatcccgtgtagatacacaatgcaaatattcttactggaggtcatttacatgcaacaagttgtcttacccataaaagattcaaacgttcttaaagaggttcaagatacgttactcaataactttaaagctggccgacgtaactatacgatttttcaagttggtaaagcgacgctactgcgagtgagtgacgttatgggtttaaaacagacccatatttttaatctggacggttctattaaacaaaatgcgttcattcatgatcgaaaaactggtaagcctaataccttgtaccttaaaccagttcaaacagagctcttattgtatcgtcaatggctgcttgatcatcagctgggctctgaatggctctttccttccattcaacaccccgaacgacatatcacggaaaaacagttctacaaaattatgagcaaggttggcgatctgttaggaattaattatctaggtacccatacgatgcgcaaaaccggggcttatcgtgtttacacgcaatcaaattacaatattggcctagtaatgcacttactaaatcactcaagtgaatcaatgactttagcttatttgggcttggatcaagcaagtacagaaaacatgttgaaccaaattgattttgggtaaattggtttgattttgttgtcgccaacggcgacttctaatacaggttttttgggggttatcacaacatagaataaattctatgtgtacattgacctcgtttcactcgttcttctgattctcttaactttaacttagtgtatgccttccgcttcgctatttcaacttttatcctttgacttaacattctctgtatgatatagtgtcggtgattatttttaatatgattggagggatcgttatgtctcaaagcaacttagaaaaacaagaagctaaattaaaatcccttaatcaaaaaattaaggacgaaaaaaataagattgaacaacggctaggtaaacaaatcatcagtcaagccaatttagattatgctaatttgtctaacgatcagattaagcttttagccaagcaattttctgaatttttaaaggtaaagtccgtagatcattagccatacgagatggggaaattccatgtctaatcaatatgaaaaactagtcgagcagcaagcgcgtttaaaacaaaaaattgagcgggaagattttaaattacggcaatctaaatactgtgaaaatcggcaagcccgcaaagcccgttctcgccgattaattcaaaaaggggctttattagaaaagtactttcaagctaataacctctcggtcgaacaaaccgaagaacttttaaaaacatttgctgactatgttaacgcccataaaccggataaattaaaaaacgatcaacctaataactaggccgatcgtttttattttcaggattgttttttggcttaatttctggattgtgtttagcaaagtagactaaatttaaaaaacactaatactagtgctattatgcttttaaataaatgaaagcctttcaaaactattattttttgaaatatctaactattgccgtaattattgcaagtaagttaaaacaaacaataaatatagttcctaataaatattcagtattccagaagtctttaactgcagctgcagtgtgaacaccaaacagcatagttccaaaactataataagcagaataaatcgttattaatattaatccaactatattgatagctattaagcctagtaaccatttaatggaattacctcttctttttgattttaggtcaagcgtaaaatctgaaattttattttgatctagcttacttaaatgaccgatttctttaaagtttaaaccggctttgggaaagcgataaatattaccaagatcgacccaggaaggtttcttcaacccagcggattgccaatcttgaatcggataatattgttgcttgatataagccgacttcttttcatactgactagtaattttaaaagcctcgaccgtctgttctgatacccgacgaattaaaactggccgagacttgccaccgttagtttctacaaaactaacgtataggctgactaagtcattagtcctcatctggatcgttgagccaatcagcgacctctttagcgtctttgaactctgtgactggtgtcccttcggtcgcctttaaaagcgtaaattagctctttcttcttcgcttaaagacgcattaaaaggtaaagcaccattagcaacaatccgcttgtaaaacatgttaatggccgtggttggatttaagcccaattcgcttaaaactgcttcggtatcatcggccaaatctttatcaatcttgacttggacccgtttcttttccttaactgccatgattgtctcatctcctttcttttactactaccgttacactaccttttgagtaccttatcaatagataaagccctggcctcaaatcacttgagcttggcgttgatctaaaggctgaacttttgagctggttagcctggttagctctggcaatcattcaaaagcccctattcttctgtttaagccatttaaatctaacttaagtataattggctattaagtcttaaaactgcttagaaagaattttgtagtcttttaggactagtagtacaacccactgttatcgttgtcggccgacttttcttcttcgaggtgtttggtcgcatattctctagccgcttgtttattccaccaaacgtcaaataggttttgcatggtgccgtataagtagttctcaacattcttgatgtgcttctcattgctcctcagggcgttaaagtagcgtctcaaggctttagtcattaaaggtttcagttcctcatcatcaagtgggattatgacaccaatatctttgtgatctttctcaactcggtacttagcatttaagataatgccaatgaagcgctgcatttgttgcggagtgcggcaccagaaacttagtaattgcacggcttcgggttctaagaaaaccggtaagccactgtcttcatcagttaagaagtcattagcatggttcaccaaatcctggttttgtttttgaatttctgctggtgaaaaatgggctgtggaaaagtccaacttttgagtatctatatcgtatctattagtatctaagttattagtattatatagattgtgtctcatttgtgctagtccgcttgtatcaagggttccagccgttttattagcgaaatcctgtttaatatacacgtcttttgctgtaacttccaaatcagcaaggtaaagtcgattgggtaaatttttctttttcttgggatcaaatccttgattgatttggaataacagtcctgcttcttccaactccttttttacttttgatatttttcggtcactccaaccaaataaattttgtaattcatgattggtaaaaataaagtacaccctattgttttaattgctacacttaaaaacctcgcctaaatataaggagaggtaaagtgtaaacctatatgacttagttcatcgactcaattggaattggattatcaacaattgccatttgagtttctttatcaaaaaaatgagccttgttaatatcaaatccaaccctaattcgatcacctggattgtggaagtcacgggcggtaacattggcaatgtactcttcattatcagttttcagatacaattgctcagttgcacctaataattcagaaacggatacttccgcttctacaacagcatccggccaagtatcaataaaggccttctcagaatgaatatcttctggacgcacaccaaaaatgattttcttaccgttatacccttgctcatttaaggtcttagcgcgtccttctggcacctccatcctgatcttgttcccatctgacactataccgtttctgtaggtaacatggaaaaagttcatagcagggcttcccatgaatccagcaacaaaaatattgcgtgggttcttgtaaacttcttcaggtgtaccaatttgttgtatttttccaactgacatgacaaccacacgatctgctaatgtcattgcttcggtctgatcatgtgtcacgtaaatagttgtggtattaaggcgcctatgtagctttgcaatttccgcgcgcatagaaactcgtaatttagcatctagattagataatggttcatccatcaaaaaaattggtgcatcacgtacaattgcacgacccaaggcaactctctggcgttgtcctcccgacaagtctgcaggtttgcgctgcaaaaattcgttcagtccaagaatacctgcagcattatcaattcgtttttggatgttatccttactataatgtcttagtttcagaccaaatgccatattatcggcaacagtcatatgtggatacaatgcataattttgaaagaccattgcgatgtcacggtcctttggggcaatatcgttcattaaatgaccatcaatgactagctcgcctttggttatatcttcaagcccagcgatcatacgcaacgtagttgatttaccacaaccggatggaccgacaaaaacaataaattcacgatccttaatgtgtaaaacaaaatcttcaacggcataatcattaccatcatcataactcttgtataagtgctttaaatcaatttcgggcattttaatccttctttcgcggttcgataagcctgcgtcatggccttgttggattaggtcgcgttcatttggcgttaaatggtggcgtttctggtgaggtgtggtaatctgtaattgcatcaaatcaaacccgctttcattgtttgtgtcggaacttcaatgataacacgagtttgatttgatgttttttattgaccaaacgcttgtctatgagtggctaacttgattataaaatccgccctgaaattaatgtgctgctgataccgttttttgctgttgatggcggtataacatgatgatcaccagtgtcgggatgagcagaataacactgatgatatctaaacaaaagtaggccgctaaactctccaggccaatgacagctggaatcccccaaccaattgtgggccgccgcaggtagtaccgcgccagcagcagattgaccaacccgctcagcaaaaatgcggtacccaccaaaccggtaattgttgccaccggtacaaactgggcatagccttgtaattcaggaatccggtttagcccggcaaaccccaagataatagtcaagattccatcaatgaactgccacactgcacagatcaacaacaatcgctgactccatttctttttcatcgtgcactcctatcccttcacaccaacagataacgccatggattgcaggaagtacttctgcgcgaagaagtacagaatcagtgtcggcacaattgccgccaacgctcccgccatcaatgtcggaatattactggcgtacataccttgcaacaacttcaacccgggcgtgatcggcatcttgttcaaatctgaaaacacgatggatggccaaaggaagtcgttccaagatccggtaaaagtgaatagcgcaacgacgaacagcactggcttgatcaagggcagaatcacccggaagaaaatctgcgaatccgacgcgccatcgatccgcgcggcttcatcataagaaatcggaatattgtccataaactgacgcactagaaaaatattgaacactccggtggcggcaggcacgatcatcgcccaatccgtattggcccagcccagagtcgtaataatcttatacagcggaatcaggttcattactggaggaaacatcattgttgccaacagaccgtagaacagaatgtttttgccgcggaacttgagccgcgaataggcaaaagcggacagagacacaacacagagcaccagcaaggtggtgccgccagcaatgaccaatgagttcaaaaaccagcgaaacactggcgtattggtcgtattcgccaacaatttagtatagttgctaaggacccaattgatgggcaaaaagcggaaccccaccgattgcatttctatattggtcttaaatgatgatgtgataccgtaaagcagtggaacgatccaaatcacacccataatggtcagaaatagaaaggctagccactttccggctcgattagtacgtgtattttgcatggattattctccctcctaataatctcgccgcaagaagtagaactgaatcatggacacaatcaggatgcaaacacccaaaacaacggccatggctgaggctaacccggctaaggactgaccagcaccaaaagcgttttgctgaatgtacatcatcagaacactggttgatccattgggaccgccattcgtcatcattaacggctgaccgtaaatgttgaattgggcaatcgtggtcgtcactacggtgtacaggaactgaccgcggatactaggcaaggtaatgtgtaagaacttctcccaactagaggccccgtcgatatcggccgcttcgtagtagtctttcgggatgccattcaaggcggcctggtagataatcatattgccgccaatcgtccaccagatagtgacaatgacgattgtcatccaggcccacggctgtgtcccagtccacacttgattaagatggaacaaggagctcagcggtccgtagtttggattgaaaatcaaaatccaaacgatgaccactgcagaaattgggaacagactaggcagatagaacaggccttggaaaaatttgccgaattttggtttggcattcaaagcgactgccaataacagcgggaccaagatacaaaacggtaccgaaatcagaacaaaccataatgtattccacaaaccctccacgagctgggtatggaacgttgaattactgaacaggatcgtttgataattctgtaaccccacaaaacgcggagtccgtacaagatcccacttagtaaacgaaacataaattccgaagaccaacggtaccaggaagaatattgtaaaaatcaccaagtgcggcaatagatacagatatggtttgctggactttcgccgcgtctgcgcctttgcgcccgccgcaacatgtgttgtcgtgctatccatgatgagttccccctcactccgtgatctgtgcatcaattttgtcttgcacagtactttgcatatccttcaaatatttttcgatcgacgtcttaccaaaaactgggtctaacgcatatcgatcaagaaagtcggcgacatacccgttatagcgataatcgaaaatacgcaatgactcttgttctgttttgctcttcaacaggaaggactgccccatcttctgatacgccttattttttgtaattgcctgggaagctggattctgccctgcctcagcccaatgaatcgagtgggtgcggacccagttaataaacttcaaagtagctttggtcttggcggtattccgcttagcttgtttcaacagtacaaattgatgactggaggaccaattcaccattttcttgggatcggctgacacttggggcgcattggtcaggccgagcttgatcttgctttcacgaatctgattcaccatccaagtcccgtcaggataaaaaatctctttgcccgtcaagaataactgcatggggtcctgaccatcgcggcttgtaatgcccgcggcatatagcgacttgtaaaagttcaacgtatttttagccggctctgtgttgagtgttgggtcaaccccattcttggttaactcgccgccctgttggcccagcatagacagataatttggtttccaccaagttagtccaagggcagtaatgccgtctttcttggccttttcccccgccgccttaatttcatcaaaggtgacgatattatcatccaaggcttcgggacaatatttggccaccaggtctttgttgtagtacagcacatatgtatggatatcgagtggaataccatagcgatgtccttcataggagccgtcgttccaagcctcttgcacataattgctgcttttgatattgggataattgctgagatattgatcatacgtatcaagaatgccgttatgcacgtaatccttgatacgttccacatggacaattgtcaaatcaggaatcccccgccctgaattgacaatagtgggaatcttggcatacatgtccccttctgccagggaaatgttcttgaccggatactctggtttggtcgcattgtattcattgaccagcttttgcatactggtgccatcgggacccgtgaacgggttccaaaatacgatcgtctttgaatctgactgggcccggctacttgtacatcccaccgccacgaaggccagaagaatagttgccaatgccaacactagtgaacgcaaccgtcgcataattaattcacctcatcattgactttccttctgaaacatttcttaagtaccacttacatgttgataatatcatcgtaggtaagcgctgtcaacctaatcagacggggtttaagaacgtgtttagaatctttttaagagtattcgcaggaaggctaagctaatcatcatcttactggtgttcagctttcgctcacaattgcgccagaggcgccgatattttcctagccagctaaaactgcgttcgataacccagcgttgcggggtcacttgaccgtgcctaaggtcactctgtttagcaataatgacctcagcgttaatcattgcctgaactgattgagcaaagttgttaccagtataaccaccatcggccattactcgttgaaccaggtcaaactgtgatttgtttaacgccagtagcgcattggcgccatcacgctcagaaacattggcggttgtcacatggactgccatcggcagcccattgatatctacagcaagatggcgcttaatcccactcacctttttaccaccatcgtagccgctactttcagcaggatcggtattcttgacactttgagcatctagaatgatgaacgatgtataaactgaacgcttctgagccaaccgatgttggctgacaatttttttaaaaccttatccagaggagtgataccagcaggagatggcgttttagtccaaagtaaccaataataatagacggtttcccatttaggaaaatcgctgggtaaatcgcgccaaacgcacccatttttcaaggtataaagcagggcacaaaagatatcatataaatcaacctttcttggcttagtccgcttacgtatgccttctagatctgtccggattagttcaaattgttcacgagagatgtcgctactataatggtgtgcaaagcttttcatggattaaaaactcctgtttttgatctaatttaactaaaatcaaatcgaatgtcaaagtatccaaacacgttcttatgttatttctaacttaatttgacatttcaagacaataattacaatagtaaacttgaaagttctatctgtcacgagattattaatgattaacatcaatggtaccttttaaaacttatcccaatggtttaatatagttatattataagcataaacgtcgacgataaacgctaaaatctaactatgacgcttatcgtcgttaggaattaaataaggggcaggtagcggtgatgtatgacgccgtaatttaccggtttattatagggggagtattaataatgaagctgacaacgctcacgattgtggtgccatgctataacgaggctgaagttttaccgacttcggcagcgacactacgtcggatactgcagaacatgattgacattcagcaggtgagtcagaagagtaagatcttgtttgtcaatgatggtagtcgtgataagacttggtcattgattcagcaattagaacgcgataatgcgttgttcactggcttaaaatttagtcggaactttggccatcagaatgctttaatggccggaatgaaggttgcggggaagtactcagattgtgtgattacgattgatgctgatttgcaggatgacgagaacttgattcctaagatggttgctagctatcaggggggcaatgaggtggtcttgggcgtgcgcaatgatcgttcgagcgattctcattttaaacggtggaccgccgaagcgttttacggcttaatggggaaaatgggggttcaattggtcccagaccatgccgatttcagactgctaggacgacgcgcaatcgacgtactaatggaatatcaagaaaccaatctgttcctgcgcggtattgtaccacagttgggttttaataccgaaaaactatactatcaacgcaaaccccgactcgcgggtgagactaagtacccactcaaaaagatgttgtcatttgcttttgacggcattacctcattttcgattgcaccagtaaaagcaattatgtcgttgggaattttagtcattgggattagcctcatcatggtcatttacgccatcgtccgcttcttcaccggcaatgtcatcagcggctggacgtcgttaatgaccagcttatggtttttaggtggcattcaattagtcggtatcagtgtgattggtgaatatatcgggaaaatttatgcggaggtcaaacaccggccgcgttatattatcgaacaagatgactatacgccgacacaacaaacagcccagctgaatgaaatggtaggtgcgtcttagtgactagaaagttattgattggcttcaactggctagcagctggtgttttaagtgtcgttctgttgctggctgctttaatgccgacagacttcttcaacaaggaagactgggcaaaaccagtcattctgattgtgacggcgctgggcttcttgctgatacttaatgcgatcaaaaagccctgtcagaacatttcggcgcgcacttatcgctactggctatatgggattgccggattgatcctgattgcgcaagtgtgggtggcggtccattttattgatgcgacgcgggccgatgtctactttgtgcgtaaccaagcgattgcgctcgcgcaaggcagtcatcgctgggcgtattattttgaagtttatcctaataatgtgaattctgcgctgctggaaagtgtgttcatcaagctcttgttaggcatgggcatcaaggcaccgtggatgatcctgaacttgttgcggtttgcgtggatcgatactgggatgttgtcgggattggtgctgctcaaacattggcaacactggcgcccaagtgggttattgttgatgctgacttggctgctgagtatccccgtctatagctacggcgtgtttccatataatgatgccctcgtgatgccactggcgttaaacgtggcggcgttaggctggttatttgtgaacaagcgtggctggcaacggtggcttgcgggtgtcgggacttggctactgcttgcaatgggttatgtgatgaagagcaatctagtggtgctaatcatcgcggtcctgttaacggtcggcctgatggtggtacgcgacaaaaccagatggcgactagccgttgaatggttagtgggcagtgtcgtgacattgggcctgatcacgatgttgatgacgacggctgctaagcataacggctatgtcaagaatcctgaactagccacgccggtcacgagttggatcgccatgagtttgaatccagatacgcaggggcaatatcatggtgccgatttttatccgattcgcaatacgaagactcaggctgctaagaagaaaatggcggctgagtccatcaaatcacgcgttgagcagatgggaccgcttgggttagtcgatcatttttatcaaaaactaggcgtattttatagtcatggggactttgacgccatcaatctgattgctcagtggctcaaagcgccttcacggtatattctgcaccagcggcactataaattctgggcgttattgctgacacagagctggtatttggccctgctgattgggagtatatggcaactgttcacgcagcgtaaacacttgatttcaacggcgatgctcagcttagttttgcttggactgacagcctttcatgtgctgatttgggaagttgaaccgcgctatgccttgccattattacccatcattatgttgctcgggtgtgagggctggagcacaatgccagcgctagccttgaacttcaaacgacgattggcaatcagttgggtgttgatgttgggcaccttggttggcatgctgaatctgatgcagatgagcaaaaaagtgactgtgaatcagatttcgattgcgatgcagggaaacggggcttatttcaccccgaatacgctgggcgttaaaacgcgcgatcacttcgttgttcaacttcatggtgaacaaagcaaccaattagtgttacacaccaagtcgaagaatcgcgtgacaatcgttgttaagcaccaaggcagcgtcttgaaacgagtgacgggtcaagctgaaaaggtacaacaaatcaattatcgggcggtccatgctaagcagctgaacgtcacgatcattaatcatggtaagacgccagcactttatggtagtgggctactgcacttttcgaatgacacgggcgcaattaccaagcgacctcaaatgaccatgcaatggaatgttaatcgggtctttaagccaaagaacccaacgcaaaaaatcaagttaacacccaataagtcgattgcggcgatgacgggacttttcctggtgctagtgctagtcagtatctggtatcgtcccgctgatgagctaaatcaacgcaaacgggtttaatgcgaatatagtaatgtcttgtaaaaggctgtctcggtattttaaccgaggcggccttttatgattgaatcgtgttttggtttgctattcgtcggccggggtgcattctcgattgaagtgaaccctgcaagttggacactttaatttaggcaacttttcctaaggcaagattccgatatttaatcggcgtcttgccttttaatttatgccttattcgatattggttgtaatatacaatccacgccttcatggctttaatcaattcctgtttggtttgataatgatgatcataatacaattcagctttcatggtatgaaagaagctctccattgatgcattgtctaagcaggttgcccggcgtgacatactttggaaaatatgatgcttctttagtgtctggcgccatgtatttgtttgatattggatgccttggtcactatgaacggtcatgcggtagctaagcacgggccgcttattaattagctcgattaatggtttcatcacaaaatcagtagtcgggtgatcgctaatattataactaacgatctcaccagaacacagatctttaattggcgaaagataaacccttttgtcctggctcatattaccatagcgatactcactcacatcagttaccattttctgataaggacgatcagtgttaaaccgtcggtttaaccgattcatagccttcttaccttgggggccaatcgatgaatcatatttacgggtttgacgattatacattagtgacgatagcccattttcactcatcagacggctaactcgtttgtgattagccttgattccacggtggtgtagttcatcggttactggtcgatatccatagccgggattctgttgtttgatgtctttaatgacttggagtaattcttgattatctttagcttcatgacggtgtgcttggtaatagaacgtactccgcttaatggtggcgtatggcaaaatctccgttaagctaaatccgaattcgtgccttagttcttggatgatttgatattcttctttgactgtccgcgacgttgaactaaggcttcgagtttttttagatattcgttctccactttcaaagcccgattatcagccttcaagcgctctaactctgataactgtttcctagcttggtgattatggttagtcatcatgtggtttgcccgtcctcttctggtaaacaaggcctcagaacgtgtttggatactttgacattcgatttgattttagttaaatggtagattgtaaaattaatccgaacgctgttcggacaaaaaagatcagcttcctttaaaatggtgtttaccacaaacacatcttttaggagctgatcttttgtctagtataacctattctgaacgaattaaaatcgaaaccttttgtgaactaggcctgtccaatatccaaatgagcgatcgcctaaaacgatcacctgccacaatttcttatgaattagctcgatgtgaaccttaccaggccgaagtggcccaaacagatgccgaatacaagcggtcacgatgtggccgaaagactaaattgaatgacaaattaaggcaaataattttaaaccatttacggctaagttggtcaccagaaatgatagctcacgaatttaaactagcgactaaatcaatttataattggttaaatcaagggaaaattgagttttctttaaatgatttgcctgaacatggcgtgcgccaacggcgtaaccttgaccaacgttctaaatataatcaatcattaggacggtcaattgaacagcgacccatcgtggttaatcgacgtaatcgcatcggtgattttgaattagatacaattgttggcccccgtgggcatagtaaggcagttttattaaccttaatcgatcgcaaatcacgtttcctttgggcctaccgattaaaaaaccggacagcaggaactgttaatgaagccctaaataagtttctagcaacttttaatggcccggtgcatagttttacggtggaccgtggcactgagtttagcggtctagtatcacttgaagcacaatacggtattaagacctattactgccatgcttatacgccagctgagcgcggcagtaatgaacgatttaatcggaacttacgctatttttatcctaaggggacttattttgagcacattagtgctcaaggcttgaaaaccaccttactcgaaattaatcagagaccacttaaaatacttgactggcaaacaccttatcaggtcatgctgacaaatttgtccaaaaattcggattaaatttgcaatctaccccataagtaggtgttttataatgaatattgaggatttaaaattatttataaatttatcagaaacattaagtttttcacaaactgccaagaacttacatgtaacacaaccagcagtgactcacactatcaataaacttgaggtagagttaggctttaaacttttcaatcgtactaaacgtaacgtattcctgaccaaaagtggtcaatttcttcatgataatatccaatcattattactaaagttagacttgactatcgaaggcgcccgtactttcgaagaaaaaaacttctcctcactattgattggttatactagtacttattatgaaatcaaacactttcctcaactaattaaagaatttaataagctgtatcctagctcccgtctatatttagagaactttgatcacaatgttctcaagcaacatcttttgagccaacaatgtgatgttattttcccaatgcaggatagtattatcaactcagccgatattcaatttatcccattaattactggacaatttgcttgtatcattcccactaataataaattagcaagtcaccatgctgtttcaattagcgatctcaaacatgaaacaataatcttatttaattcaaacatttgtccgccacgacaatttaaactacaacaattcattaaacaagcctgtcctgatgcaaattatttgtattctgattcggtgctattaagtcatactttagttaaaggcggactcggcattgccattatggtcgacctagccagcgttaacgacgctaacaacttcaaagtcgttcctttaacttatcccgaccatactccctatatttatggagtggcatttttaaaaacaaaccataacccagcccttaaagaattcatcacttgtgctaaaaagaatttcatataagacatttaatataagaagtctcaatagaaaaacaccaacaatgtccctacaatccgacattgctggcgttttgttaatatcattcttagttgttatttcccattttcgcaaaaacctctttaaccaccgtcaacgcattcaataccttcggaaaaccaacgtaaggaatacaatgaatgcaagtttccacaatttcagtacgactaagcccaacgttgaggcatccgttgagatgaacacgtaactggtctgctgtatcaccttgcgttaataaactagtaatagtaacaagttcgcgttgttgcaacgataaaccaggacgtgtataaatatcattaaatgcaaattcaagaattagcttagccacatccggtgccaccctatccaaactagccattacatgatcagctgcttcagcatccacccgttgtaacatggcttttccattaattaaccgttgcttattttctattttaatcagctccttcatttgattgattctaggttacaacctcgggtgtacccgacatcaagctttatttcaggaggttttcaaattaatgcaaattggtgaattttcacgacaaactgacctaacaatcgatacgttacgctattatgaagaagtcggcctgcttcgtcccacgcgaactgccggtaatcatcgtcaataccaggctaaagatatcgactgggttaattttttgaagcgtttaaaacaaacgggcatgtcgatttgaaacatgcaacgctacgcgcaattgcgctatatcggtaatcaaacaatccctgaacgtttgatattactgcaaaaacaagaagcacaacttaatgacctaatggcagcaacacaagccaacttggattttcttaatcaaaagatgacaacttatcatgaaatgcaagaatcaggcttcgaatcccattaaattattaatattacatttaattacttgtttttcgtttagcattgtataaactgctatccaccgtttcctatacctcttatgattaatatcagatttcaattaatcatttggagggattattaatgaaaaaagcggggattttgggactaatcatcactattatcgtattagtaccagttggtctcggtttcaactggtaccactcaaattacggaacaaaaacatactatactcaaatcacgactaaaggtgaacgtaaaaccgggaaagatgattccggcaagccctatgtctactaccattactcacaacctggatacagcgacaacggtgttaagaaagagctcacttttgatagcgtcctaccacgctcactcaagatgcacgcttatctcaaagtcggttataatgacaaacgccaacaagtgattaactgggaaaaagttgatcaaaaagacattccccaagcagcactgaatagaatcaattaattgttaaaccccagcaagttaaaagctcgctggggttttatcgtgtttagtctataacttaatcatcgattactatgtcgacaaattactgcacctaattaatttgcataatgacaattaccgttaatggtttcttcctttcatgaccaatatctagtatttcaaaatccgaggatcaattctagctcacggctttttacttaagcttagaattgccactttcaacaaagcaaataaataactatttaagtctattattgaacaaaatatgaatttagtattaatattttgttaatatttttaaccagttatgatatgcttgttttcggctgccataatcattcactcggccatataataaaattctacttatattcataacatttcgcctagtataagtactccaggaggaacatcgatgtcagaaacaaagtattgtattaactgtggaaaagcgattcctactaacgcgaccttttgctctttttgtggcgcaactcaggacaaagtcgcttccactgaagatcagaacaccattacttccgagcagcacaacacacctaatcaaccagaacatgtcaatatgtggaccgcactaaagctaggaatgcgtcaaacctttacttggtcacaacggattacacggcctcaatattggtggctttacttagatttggtcctaatttccctagttttaaccatcgtacttggtatcagagcatacagttatccagcttttatcctcagcccattacacgttaatgttttacaaaccgtgctgttattgattttttcagcgctcatgttttggacttcagtgatgcaattcacagccagtgcgcggcgactccacgactctaatcggtcagcgcattatttatggttctatctgcttccacttgtcggccccattttaatcattgttttcctatgccaacgctctgaaccagctggaaaacgtttcgaccgtttagctagccaaccaaaaccttggacacacaaatggtggacttggtgcctgctagtcttattgacattgggatacgccgctctcattaacataacggcccgtgatactgccatggacgccgctctgacgacaacttccaagtcagctacaactaactctgacgacagttacagcgatagcgacagtgaagaatctagtgatagcacggactctgactcagattctgacagtatcactattggcgacgacgacatcgatatcgccaatcaaaaagcttacagtacctcatttaccgacagtagctgggcgaaatccacatttaaaatcgataaagtcacggtctacaaaacagacggcacctatactagcggtagcggtaatgacaagaaagattttaacggcgtcgtaaaagttcacatgagtatccatgctgggcaagatatttcagcctaccccacccaggccaagctcagcaccaacgatggccaacaggtcgacgctgatatggatagtgacgacttcgacggcgacttaaacagcggcacggatactgacggtaatttatactttgaattatcaaaattatccagcgtcaaagatattaccagcatccgcctcaaatgggacgccagctacgatacggatgattacgatgatgacaacgactttaagacctacgatgcgacacttaatttgaattaatttttagtacctagatgcgttgcggattgcgatgtgagttgtgatttactggcattgtgttggtactgagagcgacgaatttacaattgaagtgcaacaagtaagaaaaaaataaaaaagaactcatagcctgagtcctataaaatgaagtcaccacaacaatcatctaaaggagatcctaggctatgagtccgtacaaccatcttaccttaaaagaccgagaatgcatactgttgggcgtcactttaaacgatacctatcaagttattgcggagaaaattgggtgttccaaagccaccgtatcgcgcgaaatcaagcgcaatggtggtcgtaaggcatactcggccgtcaaagcccaagagaactatcagggacggcggctaaaaagccgacgtcctaggcttctaactgatttgaagttacgggattttgttcttcactgtattgttcaacgtcagtggtccccggaacaaatttccggtcgtttagtccacgaaaacagtgaatggcatgtcagttataacaccatttatcgtgggattgaacgtgataatttaggcatcaaacgtaagaatcacgaggctcgtggctttgcccgtaagctccgtcaccgtggtaaaacccgaaaggtcaagggaaccattaaggaacgtcggggacgatttaacgacgtcccttccgttcatgaacgacctgtttcatgtgagaatcgaagctggtttggtcattgggaaagtgataccgttcgcggtaaaaccgggcgttcggccctggtaaccttggtggaccgcaaatctcggtatttattatctcagcgggttcccaaagtaaacgccaagaacgtcacacaagcgatgattgacctcttgcataccgtgacgcccaaacgagttcggacgcttacgccggatcgtggaactgaattcgcaggataccgcgaagttagtcaagagctaagtatcccagtctatttcccagatcctcatgcgcctcagcaacggggaaccaatgagaataccaacggacttatccgtgagtatttccccaaaggaaccgacctagaccaactgactgatcaagatatcgacaagtttgtcagggatttaaatcaccgaccacgtaaggtcttaggctggaagagtccatttgaagttttcttcgggacaaagttgcgcttgatttgacaattcgtcgcattaaaaatcccctgagttggaaattcgactcgggggattttttatcagttacctttcgcatctaaaacaatttcaaattgccaaaaagtagaagaggcaactttcaagctgtgctaaataatcatggactagcttaaacgtgatgctaaatcatcaattttcacaacgttcacttgtttagctaagtcgcctttttcaactaatcctggtccgctgacgacacactgacctttcttcaaagttgtcaattcttgttcaaatttattctgctcaactcgatcggagcttaggatttttgcaactgctttagtttgactctcgggaggcaagaaatgaacctgctctgcagcgttataaattgcatccacttcgcctttaatactactcaaagactgtgtcgcaaataatcctgagaacccaaatttccgaccttctcgtaggatcttaacagttggagaatccttatcaaagtttaaattctgaacctcgtctaaaaagattggataaattaactttttgtcagaatcgcgcgttttataattaagttagccacccagccaaaatggtaaaaaaaagacaccaagacgaaaaattcaggtatcattgaagttcctacaacaaacaatgaaagaagttttcgtcttgctgcaagaacagtctatcacaccacgcccaaaaggtcaccatttatcggaaatcgaacgcggtcaaatcgccgcttggcacattgaaggatgctcagcacggcaaatagcgattcgattaggcgtctgccaccagaccgtcaataatgagctcaagcgtggtcgagtcacgcaagttaaacgcgttaataatcagaaacactactttgaaatttacagccctgaagccgctcagaatcgctatgaaataaagcggcaaaactgtggacgtccattaaaatttagccaagtgacggccttcttagcctactttgatgataagttctgccatgagggctggtcgccggacgctgctgttggttatgcccgtaagcaccggttatttaagccggccaaaatggtctgtacgaagactttgtacaactatatcgatgcgcaactgttggagatccgtaaccttgatctgctggaaaaaacaaaacgccggacgacccaacaccactcgcaccaacatcagcgcctactcggtcgtagtattgaagaacggccaaagcgagtagaaacgcgccacgagtttggtcattttgagatcgatactgtcattggcaaacgtgctggtagcgagagtgtcctattaacgtttaccgaacgtaaaacgcgctatgagattgtccgcttgatcgagggtaaagacgctgaatctgtggcttatgccatgcaaaatattacggctgaattcggtgacgttatgcggacagttacggcggataacggaacagagttcaccacgctaacggctgcgcttgagggtattgccgagacttattatgcccacccttatagctcggccgaacgcgccactaatgaggtccacaatcgtatactcagacgttactttcctaaggggcaatcactcgatctagctacacccagtctggtccgtcaagctgaatctcggctcaaccatctcccgcgccgcttacttaagttctgtacaccagctgaagtatttcgaaaggaattagcacgtgcgcgcaaaggccgagccgcctaatcctgatccacctggaactcccatgagccctttcgtctgtgtgctttatcggtactggctaacttactattgcaatttgcgtttttgtcagaattaagcttggcataattaataagatcccataatagaaattcaatcattgcattttgtaatgaagctggataaccacttagttgaataatattagttttccctgtcgttccaaaataatttgaccagtcaaaattctctttgtatgtgaacggatctctcatcagtaacgcttgcagtcttccatacaacttagtatcaattgattcgccgctatccagaagcgtctttttcaacgttgcaaacgtatagttaggattgccctcaaggccactagtcatgacagtgactaatcgacttttttgctgaatgcctagactaaagacaaaatccaaaacctcagcaactcgttgtgcaatgccagatgcgtcctccaatttgtgataagtgccaatatcaaatcgctgtggcgcaaatgggttaatcggtaacccgtcagcaagcacaatatgctggttaatttgattgacgttttctttaaatgtcgggtctagttgatcaggcatgtaactatctgtataatcaataaccactgtatcgatttttgcctttgaaaactctagcaacagtgtctgaatgaaatatgtctttccttgacctgatttaccagtaatcagcatatgtcgatttgctagcttatcacttccatactcccagtacactttactagtagaaccatcaattgttccaatacgaatacgacgagttgcctcaatttcttctttctcatccaacatatcattttcctcgtccaatttattatatgtgtcttcgtccttagcagaaacatgtgattgattttcatttggtgacacctcattaccctcaggttcgaagacatcaccaacagtttgaagcgtagtgtgcttgccgggataactaagcgcttctgcttctgtcatttcatttgcttccacttctccattgtcggaatctggtactgcttcatcattttccgtatgcacttcagcctgctcggcttgtatacttttagtttcaatatcattaattagcatttcatttgttaataaccgatgttgatcaaaaccgaagtgattattttgaatctcatcaattatccattgcgtctcttgaccagcaaatgaaaaggcatcatcttccggtacttcaaccgaagtataatcgtccataattcgaatttgccggttcgtataacctgtcttcaatgagaagatgaatttgttatggtagcaactcaacattgattggtttacttcaatgtctccttggacaatccgctgtttggcatacatcagtccattaaaactagtcaagtccatctcaccgttggagtataactttgcagcatttgcaaagtatagtttcatgaaaaagtctaagtagaactttgctttaaaattctgttgttttactaatgtctcattcaagactgcagcggtatgctgaacttgctcaattgctttatcaataactgtactggaattcacaccaaccttaacttcggtcggcaagaacatcacatcataatgagctccatcttcctttaatcccatgaataacaagtcatcagatattttacctttagctccgaggctttttgcactaaagattgcatcagaacgactttcaccgacaaatgatccagaaacacgtaatatttcttctaaggacaatggtacccagattacatcatcccgctgaaggattcccaacatttcttttgaaactgccagaatgctcagtttttctttgactgtcgttttctgctgcctatgactgactaaacgcaatagccactcaccattgatcatattaaatgtcttaataacattatcaatatacgaactactattacgttgcttgatattctgtggcaaattctcagataaaattgtgcgatactgatcgacttgctttgttaatgtgattgactcataatttactgaattcgtgtagtctgtataatgaatgacataaatatcttggcttaacttattaaaataatccaattttacttctggatttaatactgttacccaattacttttatcaaattgagcttgaaaatcacgactatccacttcttcaatactattcgtcaacgtcataccatgggtcatcgcaacatgcttctgcgccgtcgccactaataactcgttccaggattctgcaaaatgaactacttgagcactatcaccatcatttagccccttagttccaaatccatcttttaaactgtcttgaatactggtgtactctgtaccaccaatgacaccatttaaagaatagttcatctctagatttgacctatcggcaccatctaatgttaattcatttgcaaattgatagaaagtaatgtgaaagccttcgtctggttcaaaatcataaaagacattgattttttctttcatcagctcaagaacttcttcatcggaaacttctttatttttcttcaatggttcagtgaagaagtcagcaaattcatctcggttactcaattgataaaatccattaaagtcggaattaacggcatcgtggctagcgcgtaacatataaacattaactggattgatttcattgatagactgccgacgtttagttacttgttcaatttccgaatacaaataatcaactaaactcttaattaacggcttttcatcagtaacattaacaaacttgatattataagtactctgagggttaatatcaaacaagtaattgaaatgcttcttaaaatctttgagtcgttctgtaataatcgcttgcgaaacccgactgaactttgatctattgttttctgaatagcacaaccaccgtggcgcattttccgaagtaaacgcacgatagttaagttgattgcgtttcaaaaacggtaccagatggattggggataacttctgctctaaggttctggagagtttttcatcatgaacatcgctttccacctgaagctgatagcttaattgcatcggattgaggggggaataactaacttcatggctactgttccaatgttcaccgattcggcttatgttgcggacttctgtcggtaactctacaccgtcttcagtatgtgtaatttcttgttcgacttcagccaaaatatcacgtacactctcaatgacctcttgatcccaattaattaagctcatcaatgtcatacgtttcttcaaaacaccaaataaatgccgatacttctctgtcaattgcgctgaaatttcagcaccatcttcaatcagtgtttcagtattaatttgtttctcttctaaatcaaaaaaagttttctgattgttaaaaacactactgatttcactaccaaaaatgattcgctgattctgataatgaccatcatatgaatgttcgcgacgataacgttcaatatctagcgcacttttaggctgaattttattatcatcattatcaaagacattaaaattgagtggaacactacctagtgttactgtaaagctttcattatcatcatcaagcgataattgactgagatcggcctttaattgatcatttggaccgagcatcagattatcaagttggcttgttttatcaacattcaattttttagattgaatcccggagcccaaaattagttcgtccatatcactcggtatctctaagttagcctttttctcccctttaactttaactctgtaatatgggcgcaaccccaatattttgttgtcagtaaagggtaatatcagtatattaaaagtaaagcctagactaccaatatcatggtgtcgatatcgtactttgacactttcaggttcattagttttcaaatcagaaaagtcaaccactaactgattcttatgtgttccaaccgtatagtgcttatgattgattttggactgagtaatccatttatcttgaactgtagcgtcgaaggggaatttaaccgttaatttgttttggtgtttatcattaaacacgataatataacgtgttcgttgcccagctttgctagttccttttggacgatcccaaattagcatgtcttcattgattccctgcattatttctgcatcatacattaaactgattttcttattctgctttaaccgttcttttcctgccaaaatttgcttatagttaacagattgccaattattgccagataaatcactgatgagcttctcaccatcaacaatcttagtaattcgagaacgtacatcgccaaagccatgtgccaagctaatattcacgtaatcagcatgattttccgctaagcgttcttccttagatgaatatgtggataaatcctgatcttgaaaataccccatttgaatgtagtcagaatcagacaactcacctttttcgatgatgccgtacacatcagcaaaatccattaacgtaagctcttgttcaccatcataaatggttttcaccataaatttcagaacatctttatcgtctttactgagtttttcactcttatcgacagtagcttgcacattacgtttaagcgcgcccgtattaaaaggtcctccttgacgcccgatgtccttagcaccgctattgatactatccaaaactttatttgagacaaacaatagcgccgtattttcccaaacaccttgctgttgtccaattctatttctcaaattaactaaataatcaggggtcacctcaactgtggaaacaacaactagttgcatatgactatctgtatctatgtcaaatgccagcgcattaggaccagactgctcatccattaactgaaaattatgaatgtcattaaattcagataatacgctcataaattgtcttacttgatcatcattctcaaagtttaagacatatctgtctccggcctgtatagtgattgtttgactccaatcaatcagccgattgcctaaaaatttatagtattcccttaacatattgtgcatccccactatcactcagtttttccaaaacattgacacgttcaaacaatctaattactctttccctacttaagcgatcaaaatagacaccgcgttgttgcaactcattgaaaacatcttttaacaacatcttatggtttccaactattgcagctgttaacatcaatacagtctgattacttaatgaaaaaacgcgccctaaacgaccatgctgccgaatatatccttgttgcgcaatctcgtccaatgacttagcgtatcgtgaatctggagcacccttttgtttttccaggatcattctcagtgtattaattgcagacggcaaacttgtataattaaactcgatatcatctagctttccctctggaacttgttcgcgatatgcttctataaattgcttcaaattatccattagttccatacgatatttgaacgtctcatctaaaatttgtgatttccaataaaaacaatcagctggaattaacgcattcaagtaatttataacatccatatcaactaataaatcttgtccgtgctgatagactaattgataaccttgctgaattgagagtcgtgattgcgacacaggttcattttccaacgtaaagtagagcggtatgattgtttcttgctctgttgcgtcactaatacggctgattaattgaataacatacgtgaaataataaaattctagtagttcatcgatgtgttgataaaaatagtctttgttcgttaagaaatgctgaatatctctagaaaaacatttactaaaccattcatgatcataaaaagtaaagaccatatcagttccctgagtatgttcatccgagttcgctaacgattcgtatagaatcttttcatacaaattaaacggttgctcggccttaaatgcattcacaaagtcttggttatcctgtagtttcaacagttgaatcagaaaaaggcctagcctaatttcacctttgctttgttgatccgttgatagtggctgatactgtagtaacttagcactttgcatttgttgataattgctccgatcaaacagctcggccactttttcagtatcgacagtggtctccaaagaagtcgacgtcagtgcgaaaggtttctgaatcatttccacgctttcaccatttagttgtcgggcaattactcctacaatggccccaaacccttcagtgaattttactcgctccggatttcttgtataaaacggtagcaaccaagtactgatatcatgcttatacttcagtgttttatcaaaattcagtgcacggccaagctcagacaccaagttattcattaattcatagcctccatttcgacttcaaagccatcatccgtcagacgataaaattccttagtttcaatatttccaatcacagtttccttgactgctcgattgctcttaataatgttctcaatgaaattagcaacattaacaaattgccgcttatccttattcttcaataaatacccctgattcactgtttcaatcagcttgaataaatcataatcgacggacaacgagtaacttgtgttaacatccgaatttttaagactcaaaacgacattatttccaactactgtaacacctgtaaagttcatatcaaatggaattgcaatcccaaactttttctcttcgttaataaaagtataaacaaaatcactctttggactgccgcaccactgatagacaaacgccttgataagcttgtataattgtcgtactgactcagcccgttgtccattttctctggcatctcttataagtttcaaataatctaggtaatactgatcattaaatgcagcatcctgataatcaaccaaatatttaatccggatcaacaatccaactttttcactaaaatcgatttttccactaggatctccactttcctcactaatgtaactccacaaccattggatattctgaagatcatcacgatttaaaacatcgtgcgctaaatcactcagttgccgctgcgaactatagactttagttgtcagccgttcaatctgatcattttgaaaatcaattggatcaaattcgttgattttcttaattaacggggagtcgccaaaacctgcaaataacaagtatggtaatgatccttcataatttatcacttgatgctcttctaatttagccggaatcaggatatcatgaatcaattccaataacgctcgggtggaaatgatcactttagattctacttgcaccttgattaataagtatttcaaagctttctgcgtgtttttgttactaaagaattcataattatggtgtgtcagatggacaatgtgtttttctttatcttcaagatatgcattatagaatggattactttcagactgcactgtaactttgctgaatagctcatcataaaaagcactgttgaccccagtttcatcaatttgaaatacaggataagaacgaaacgacagtaattcaaaaaagtcgttcttagttatatggagacttgacgattgttctgtaattcccgtctcagccaaaaatgacaatagcttagtaaattgtccagatgctttcattcggttgattaggttcaccaaaatacccatattaatggcaacgacccaattctcacgattattctccacataattatcagaaaacggctgtaataattccattagtgtgtccatcgctgtcttttgagggtcaaagctttcagttgcatcgtaatgaatatttattttgttcagactaaaaacatctgggtactgtgacttcatatacccaattaagtgggattttccgtcacccacatttccaaccaaaaacgccagctttccgcgttgattattgaactgcatcaatacatcatgaaaatcttgctctaaattgccacggtccacatgtaaatattcttgaacgcgatttaaatgtttatcatcaacaatcgccgtacttgattgtcctgataacatatttaagatattttcaagcttgcttttctgaaaataattttcatattttttcattaattcttgaatgaattggacatctgccgaagttgccacataattgggtcggcagagtggctccacacgcttagctaattcatctgaatcataccctttaattttatctgaacttcgaactcgaattcgtccaaagttttgttctaacgtaccattactacgtggagcatcaaaggtacttaataatatggaatataaagttttcaaagctctgcttaattggtcattcaatagttgttgctctcgagatggttcatcatgggaacctgatacaaatttgtgctgaacttttttctcccctacaactgcacgattatcactttcattttctgattttgtcgtgcttaccgtcgtttcgacaatagaatttaatttttgtccacagtttggacaaaagttgaccttatttgttatttttacaccactggatgtaagctgattcctgagacaacttttaagagagggtataatgaataaatcatctctcaaaaggaaggaatttttacatgccaactcgttacgacaaagaattcaaacaaaacattatcaacctatataagcaaggcgaatcagctgcccaactggccagagaatatggcattggctattcaacagttcataagtggatccagggccaggccaaaactcaatccggtaaatcgccagacgaaatcaaagcgatggaaaagcgactggcttcgctgtctgaggagaacgaaatcctaaaaaaagccctgggcttccttgcgcagaagtaaccaatatctttgattacattcaccaagaaagccatcaccaccaggtaaccaagatgtgccgaatcctcggtgtttccagagctcagtattatcgttatcgatcccccaaaccttcaaaacgccgggccgaagatgcgggcttgaaacaacggattctgcggatctttgcggaatttaagcagcgatacggtgttatgaagatccaccatgaattgaatctggaacttcaacaactgcagcttcggtgcagtccacgacggatttcccggctcatgaaggaactggatatccactccgttaccgtcaataagtggaaagcggcttcggcttctaaaaccaagattgaacagcgtcccaacttgcttaagcaggatttctcgaccactggtttaaatcaaaaatggaccgctgatatgacctatattcaaacgaagcgtaatggctggtgttacttatcaaccatcatggacctgcactcacgacggattatcggctattcgttctcaaaaaagatggctactgatttagtcttaaagacccttgaaagcgcggttaaaaatcgaaccattactggggacctgattatccatacggatttaggatcacagtataccagcgatgattacaatcaacgtttaactgagctacatatccgccactcatacagccgtaagggttgtccgtatgataatgcgccaatggaatcctttcacgcttccctcaaaaaggaatgtgtttatccagtgccggtctttgaagattatgaaactgccgctgccgtcctttttgaatatgtgcatgctttctacaataggaagagaagtcatagttcactgggctaccagacccccttacaagttgaaattgcaacacttacgagccaaatggccgcctgatttaatgctttccagggttcaaataagttattaatcgcgattaatgatttatttgagctgtggaaggtaaacgcggttctgaatgtctcttaaaatctgtctcaaatattgacttcaatccacgtaataacccctacgagaatccaacatatccaccaaaaagtgttctgactatataaaaagtcaaacacttgtaaaatcattttttgtatagataccggaacaaatttatttacacttactaagttcaaattattaaaaaaaaaagaacctaacgcaagctatcgcgaaaactgcataggaaaacggaatagaaaaagccttttttagctccatttgaaaattttttgccatacttactaagttgctcaatgtactcccctcactaattcaattatttcattaaatcagactaataaatcaatttattacagattcatgctttatactgaaaatacattcgtcacataactatctttattataaacaaaagtaatataattctcaaaaaagataggtcaatggcgtttaccagcctatcttcctattcttactccctatcactttcaatactattctctcttcaacattcatttactcgggcactaagctaatatagtgtttctgtgtaattatcacactgacataacccaaatatttcgacatatacacaatcgaaatattctcgctaataactatgatactagccaccgtatgcctagcgtatgggtactgtacttgagtggaaagtcctagtctcttaagtaatcgatggtaggtttcattaacattttttaggcaataccccatacttatttaataggggaaactgatttggatttttaatatcgcctttaaataaagcctgtcgatggtaacgaatccaatgttttaaaacattcaatacaacatccagtaaagaaattgttttttcgtcatggctggtcttaattctttttagaaccagatattgattgttccacgactcatctacttaatgaatttaaatagagattcagcccatactagtttctctgtttcattagcaattactttcaatccagacttctctgactcagttgtgtcttcatcaataacagtccactgaacccaactcccatagtatatctcttaacgcttaatgaatgaacctttttggcatcatcgtttagtaaccaaaataattttttctgttactttttagctttacatttgttggtataattagctgattgaatcgttgtcacctcatattttgtggataacaaatcattaatccacacctttagttacagccatcagttcttagataccacctggtacagaagtttcatccaaacgtttatttcaagaccatttaacctgtgcattgcataagttagtaatcgcgacatcacaaaaagtctcacaatccacaactatatttcaaatcaaaataccagtcaggttactcttcattacagagccggctactgggtaattagctagtaccatggcgccacacattctattagaagaacttggattaccttatcaactagaaaaaattaaccttgataccaagacttagccacaaggaaactacaacaaattgaatcccaagtcgtacgttccagcacttaaagtcgataatgaacccttgatgaccgagtgtgctgtcatcttggaattcattggattacaattctccaagagtaacttaccaacctacaacactcaggagtactgagaacaacggacctggctcaactacattgccacagaattacacaagagtttcattttccccttccgcaagggaagctggttaccgaacactccagattctaaaaagttagtttggacgcgcgtaaagcctcgacttgcattcattgaaaatcatttggacaaccaagggccttatttaatgggcaatcaaccatgtatcgccgatccttacctattcgtcatgacgaataggatgaaattacttaactattccttcgaagggttaccaaatctcaaaaaactcgatgagattatgcgtcaacacccagcagttaagcgagtccttgaacaggaaggcgcgccacacacattaactgataaaaattaaacagacaaaccgctaacgtactcgataacttgtacactaacggtttgcctttttattgatattttgatgctgtaatcagccgataatttgacgcattaatggttaattcaacttgatactgccgactaacgtcatccgacttcgacaaaatattattgaccattaattttgttgccgactcgttttgattcaaacccaacttcttattcacacgttcaaaaaccaacggtgtctaacaaatttgggggctaattatattcagtatctgtgtattttcaatcatattatccctcgttcggaacatacgttccctgcattgtatcaaacttaggcaccattgataagttaatcaccgcactaaaatcatggtatagtctatacgggggctacatcatgaaaacggcactttttattatgctcaacgaatacgctgatcaggaaggcgcctacctttccagccaattaaatcaaaacgaagattggcaagttaagacggcttcgattaattcgacagtcacttcaatcggcagcttaacgacgaaggttgactatcaactaagcgacttacctagttccgacctattaatactaatcgggggtaattcctgggacgtagaaaacagtcaactttcaaatttaattacgacgcacctcgctacctcaaaacgaattggtgcgatttgcggagcagtcgactacctagcaaaaaacgggttattaacaggttatcaacatacgggtaatgcgcaatacttatggaaaagttatccacagtatcaaaactccgctgatttttctgaacaacaagttgtctctgacaaaaatttagtcactgccaacggtaccgctgccttagagtttacgaatgcagttttgaaactaactaaatttgcaactgaccaataaatcgatcaatcaactgatttatatcgactaggattttatcagtactgtcaaatttatggcaatcctttcactaactaaaatacgctagctgaccgacaaaagagtgattcctagaaatctagaatcactcttttatactgatcacgacatacttatttagtaacggcattatactcatctagcatagattggaacgtcattcacccagtcaaccggttcgtcttaaactactctatttccagaaccacctgcttagtctaatcgcgataccggtttatttgctgctaactcttgagccagatcaactggtgacaaggtgcgactcttaatgaaaacttgataagcgccggtcggtgttattacagtcggctgggtcagccagtacttcaagagtgtcataacgttttgaactaaaagctctcgggctaagtctggcgtaatttcaaagttttgatctatttggtcggtcgcatgcgtaccgatagcgactgccactagatcatggattttacgccaaaggtccgaagccgaacagttgatcagcgtaattacaatctgtcgattctgatataagtactccatcaacttaaaaaaagcatcatttgtcgggtgcgccgctatccgggccaagtctggtcgtcgatactgcctgaaaatataatccgactcatggatcaattggtcctcacagcgattcaacaagtcaaatttatctaagtaataacggtaaaaagtcccccgtgcaactccagctttagtaataatattctggaccgttaactgttggaagctttgctccgataacagtttaatgaaggctcgctgaattcaatcctcgcttgttttttgccgaaatttcattccaacgccccccttttactttgttactaacgattcaaacgttttttgtcgcgtcgctaacaagaatttaccgaaaatcaagagctggacccctacgataaacaaggtcatggtccagagatccgtggtaattgagccccccaatgaaatggcatgccgtaatccatcaatcagataagtcattggtaaaaatggatttaacaccgtagcaaagttactcgttaactggacgagataaattccgcccgaagaacccaattgtaataccaaaaatacggtcgttaaccaaattccaaagttgcccaaaagaagccggaaaccataaataacggacaagaacaagacgctaccaacgaatagcattaaccataattgtgcgtctgacattgtttttaaccctagacccatctttaaagcaattcctaaaaatcccgtttgtagaccacacacaactccaataacagaaaattttgctaaccaccagttaattgccgatttaggccgagtcactggagtataggcatcaaacatcgttcccattgctagcgcgccaacgaataaaccaattgccaccgcaaacggtgacataccagtcccattgttcggtacggccgaatcatccgttaaagttgactgaacgggttgtgctaaacggtcaatatttttagttgaatcattcaacgctaacagtcgttgctgaccggccaatagtcgatgagctccttgcgctcccccttgagcaagctgactaagcccagtgttaacgaccgtttgtcccgctgctaagccagcactaacctgtcccagttgattaagtccttgtttaagttggcctgttaccggcccatttggtaccgcgaacgatattttattcatgcccgctgtaagccttgcctgaccagtggctaacttttgggtagccgtctggacctgatttagcccgttgaccaatcgctgatcacccgttccggcgacgccaaacccgttggcagtttgatggacagtgcttaacaaaaccccgacgtacatttgcgtcaccttgaggccaacctggtgctcaatggctgtcgtggcaccggtgatcatttttgaaataacaaagttccggcctgaactgattcgataatacaaccgcatggactgaggatgcttggacaacaaggttgtcgcgttttgtgaaaaattctttggaaccgtcacgattaggtaataacgcccacttgctagcccacgatgtgctgtgcttgctttaacaaaatggtaatccatagtcttagaagtcttcaacgatgcgactagattgtgcccaatttggattgtcttaccctggtaatgttgatcaacatcgtgattaacaactgctacagggatatcggtgaccttactgtacgtattccacaaggatgataaatatagccaacaatagattgttggaattaaggcaattgccactaaaactagcggcaaagtcttatttttaaataactttttccattcagctctgatcatatgaattccccctaaaatgcttaattgaacgctttgttcaaccccacattttaagcagataccactttgattcaataaacaaaattattaaaatcgtcttacgcagacggttcaattactgtttctccgttggttaaggccgtcttaaaattatttcaatttagcttgttctttaatcattatcattattatcccaatgacactcattatttcgcaactaacaagacgcggttggttgaacaaccgtccataaaaaaaggaccgtctcgcaatcgagtcagtcctgagtattgtcccttaaattccacgttgcttagtctgaaatgcatatttatctatcaatcccgtggaaataaaccccatccgatcccacgatctacggttatgtggcatagccaaattaagcttaaactcatgaaggagttttttattgattgttgaaccggtaaaatcaatcccaacaagagtaggcaaagcggtccaatcaacgtatgtgtcgtgttataagcggtctgaccaattctaggtgataaaccaaaccctactgctgccaaatccggcaccaagtagaaagcaccgaaaatcaaccaattatttaaaaatcttgtatatactagcaaaacaactagtgttgctacccaatattccaccttagatataaccccttttatatccatggatttttcaccccttctcaagtgcattcaagtcctgactaacatttcactaaactaatgagtcattgaaatgacgttatccttaaatcaaacacttaaagctgccttagcgtgttgaatcgcctgaccaatctttgaattagcatgatttatcaatttcccgtgcctaaccatcagccactcaattggcaatttattaatagattccatactcttaattgctagttccttatcccaagtggccttggctgagaatggaaaaatccagctcccaccaccagcaataaatataccaccgtgtgtcaccatggtatctccagcaaacagcgtttttgatgtctgctgatacaatacgattgatcctggagtatgccctggggctgcaatcacttttaaagacccaatcatatttccagtattcattaaaacatctggtttagttttcactttggaattaaaaccacctttaactcgtaacttgggttctgttttattcaaactaaaatcaccattcattaaccgtgcatcacgagccgatacatataccgatgctccaggatactcatttttaacactgtccaacgaaccaatatgatcaacatgtgggtgtgttaatataattttcgttatcggtttacctagttttttagcttcttttagaatgccatttttacaaaagcccataccagtatcaatcagagttaatccctgtgtttcgtcaattaaatagcaattaattggaaaaacatgacgaaaaaatgctaattgatagatattagaaattttattaattttcatattatcccccatttatgccgatcatactcagtactaaacaaattttcaatggatagagtatccaataatgttcacagaaatctgttttaagcattgcgattactgaagttgagaagataatattatttcaatttcatggacttagtaactttacttaataataaaaaagcacaacaactttgaatagttgtcgtgcctttagaaactgattattttgaacttacaacgtggtcttcatccaacatatactggaaagcaacctcaccagtcaacaagttagccttgaatagtccttggttaccgttgttctcgtcacccatgaccacgaagtacgtggcgccttcgtcaacgacgtgttggaaactcaggtagttacctttgaacccttgcttccggaacaacccaataattcgaatcatttcacgttgcgttacttcgtttgctgctgctttttcactcatctttagttgtatccccaattctcttcttaatcttatgctgccgttttagtggctggtttattacccgccaccacgtaactatcggtcagtggggtagcccaccaaccgttaaaacctaaacccataggctgggcaatttgtaagcccgcgtcttggaagacctggccgtactcgttaatattacgtcccgtatcaatgatcatgatgtgaccacccggctttaacacccgaatggcttccttgaccgcattgattcgagcttgttcattcttgatattatggatggcaaaactggacgtcaccacgttaaaactcgcgtcgggaaaatctaacttggtcatgtcgcccgtcaccaaattaacccgatccgttaagcctaagtcgtccacgttcttttgcgtaacggccattttgttatgtgattggtcccgtgacaaccacaaatctaggcccgttactttaccagctgatcctaattgcttagcaatccgagtcaataaagcaccccgaccacagcccaaatctaagacttgaccgtctggttttaaatttaagtgccgaatcgcgtcatcaaatattttgtactttccccgagtcgtggtgcgtaaaaagatcaacgcacccaacactaatacaataccaaccgtcgtttcaatgccaattggataattcaaccgattcacgtacgcgtgccatagtaaccctatgccaaacacggcatagatcagcaacgcgaacggtgcatcgaccccgtaccttttaatattcatccagctttgtccccttttaaaaaagatccccgatttaattccacccatcttcacgggtagaatgggcgtgacgggcaccttttacaactaggtcaccgtcgcacctacttcttaatcactactttaactggtagtgaccatctagcgaccaccaccattaatccattaatttaacttattatcacctagttagtgaaacccgccaaagctttcaagtcgagtctcactactagcgattataattcatctaaatatttaatataattattttctgaaactcaaatcttaggtttcataatgacaaccagcgtccatttgtcataaaatgccaacctcatcagacgttatcggcacttggcgcccaaaaaagcactcccctgagacagcggagtgctccaaaaaactagtaaataactattaaattatttgcctaacttttccttaccaagaacctttaacttttcatcaaaatcatagacaactggttcgccagtagccatttcaaggtccatgatatcatcatcactgatttgttcgatgtacttgcttaaggcacgtaatgagttaccgtgggcagcaatgattacattcttgccgtctaataacttaggtgcgatttggtcttcccagaaaggcataacgcgttccaaggtaaccttcaagttttcgccaccagggacgatgttagggtctaagtcagcgtaacgacgatcgttaacggctgaaccttcatcatcggcactcaataatggaggtaaaacatcataagaacgacgccagatatgaacttggtcgtcaccgtatttttcagcggtttccttcttgttcaatccttgtaatgcaccataatgacgttcgtttaaacgccaagtcttggtttctggaatccagagttggtcggattcttcaagcacatagtgcaaagtcttgatggcacgagtcaaaactgaagtaaaggcgtaatcgaattctaagcctgcttctttaactttttgaccagcagccttagcttcttcaacacccttttcgcttaaatcaacgtcaacccaaccagtaaattggttagataagttccattcactttgaccgtgacgaatcaatactaattttgccatagcagttaatgacctctttcttaagttatttactcaccctattttacactgaaaaagcgaaaaatcaaaacaatatcagcgcttattttcagaatccgggtggaaagtaatcgtttttttcagattaatgttaggtcgcggccggtgaaccggtttcacgccaatgatgtccaaaataaagttaaaaatcggtacaccgacgatcagtccccagacaccaaacagacgctcactcactagtaatacgacaaacgtataaaaaatgggcagctccgtgcgactcgacataaacttgggattcaagacataggcttctagggcgtgcacaaccaaaatcattaagagcatatagaccacgtagcgcaacccaccaaccgaataggcaatcaagctcagcggtacaactgaaatgatcaccccagcgactggaatcagacttaaaataaagatcattaatcccaagctaatcagttgaggcatcttcaagattgccatgaaggccaccgtaatcaccgtattgacaatcgcaatcaagaactgtgcttccaaaacaacgccaaagctattcacaaactttttggcaaagaaatggacgtcttgaaaaaaccagccaaacgtactagtcaaaaagcgcttcgtgaagacccgcatctgatgatcctcaatcgtaaagaagaaacttaaaataaatgataagaagaaggttagtcccatattaccaatattagtaatatactggaacacaactgaaatgccgcccttcaattgtttgagtatatccgattcttgaaaatacgatgtcacccacgtcaacacttggttagtatcatgtgatgggttctgataaaaccgatagactgattcaaacgtcaaaaaagtttgtttgatcaactgcggtaaataaatcgatacagcaaagtaaattccaagaatgactagtgcgtagaccactaggacaatgatagtcggtggaatcttcacccaccgccgaactgcccgaactaaccgcgtcactaagaacgtaaaaataaacgttaataaaataatactcatcatacttgatgccaagtatagcgttaacacaatcaacgccaatacgcaggcgcgccgccagcgcacatttcgtattaactgtgaccaaaattccacaaaatccacccctctactttcccttactcccattctaacggaaagtctcagcaataaaaattaaaaggccgttgtgaatcaacaaaaaacgtgtcaagtttatcactaatcgcacgataaacttcacacgttcgtttaaataaacacttaataacttatgagaactgcatctttaagctctctaatcctagtgcttggtgaataataactgaggcgccacccaacaaggccgccgattgtacgttcttagttgcaatgattggaacttgccgacttggcgaagttagtttggctgtgctctcccgaacattagtcaatagttgtggcaaaatttctagaacggtcgtgttcaacacaaccacatccggcgcgaacgccgtggaaacattcgcaatcactttagatagatagtaaacaaagtcatcgaagacctttgtcacttccggatcatgattgatgtagtcatgcttgaccgtcgttaaatctaatcgatcaacatgcttgatggccttcaaccgagcccacaaggctttttcagaagcataatcgttaacggatgccaagtggtcctcaacgtgccgatcttctaacaaagcagtccccacttcacctgcttcgccttcatgaccagaatatagtcgcgaatcagccacgatgcccgcatgaatttgatcgcgaacgactactgaaaccacgttatcgaaaatctcattgtcatggaaatcacgttcaaaaacggccgttaagttagctttcttttccagaactaccggaatccgtagcttatcacgtaaatactttgctagatcaaagtgtgttagtcccttgatcggtgtcttgaggattttattctcataaataatcccatccagcgcaatggcgacccccatcagaccatgaatcgtaccatagtcatcaacgttccgtaattgatcttcaatcaaatcaatgacatccgtcaacgtcatatcgctcgtcttaaagctttgaaagtgcaaaattttaccattcaaccgtgaatacataagtttgactgcgtcagccgtcatgtcaatgctggccacaaaaccatagttcacgttcagctcagccatcactggtttacgactgccgtttttcgtgctgacaccacagccaatttccttgatgaactgggtccgcagtagctgattataaatatctgaaaccgtcactttattcaaactcaagttccgtgaaatctggctccggctaatcggtccttcgttaataacctgctgcagaacttgcttttcattcgtactgcgcattacatgtttattaataatcatactgaatttcgatgcccaccattgacaatcgaactactttaccaaatcatgttaatttggtctgccattaattcaatcatcaacgggcaccttaaccccctaatctgttaatattctatagcatcaaacaaaaatagtacacaaaatagtcaattttatacccattttgacatatgaacgttaaaaaaaggccaataccgatataaaatgaccgcccccgtagaaccaaaatatcaagaacgaaaactttccgtccttactcctacattctataacagtttttataaaaaaatcaccgattgacacctaaaagtaggtgttttatcgatgattgttaagtggacttccatactgttattaaattgtttatattactgcaacgacctcgctgcttgcgccagagacatatgttgtaaactggcttgttgtaaaatggcctcgatttgggcatccgtatactgactagcattaaatccagcttgcgctagctccgcacgcgttgcctgaatctgatcagagctataattcatcgtttgggcagcttgcgccagtgagaggtgttgtgctgctgctcgttgcagaatagcacgaatttgggcatcactataactactgccgtcgagcccttgcgcagtcaactcagcacgagtcgtttgcacttgactgtcaccataactgttgttagctgcagctgacgagcccatcgaatggttagctgaggaagttgatgatgaagcagccgcctgctgtttagtggctggcgtgcgttgcgtttgttgctgacttccggtcatccccgtaaccgcttgtgccgcactcgggatcaccggtgctgaaccggtcaatgtcttgagtgacgcattattttgtttctgtaaatccaacacatttttccgaatatcctgatagtaacgttgcttaaacgccttatcctgcaataaattagcaattacaacgttagaatccgtaaactcattcgctttattcagctcagcagctttctgatactgttgttgataagtcttgcgtttttgttgcaccttttttattaaggtaagttgttcttgggcctgattaattaacgtaactgcaccgtgcttggtcgtcttaaccgtcataaagtcacgtttagccacgtcaaatttccgcgcagccagtgcttcttgaccagccacataagtctgggtctgggttaaataccgttgcgcctcagtactactagctttcgttctggtcgcatgtgtaaaactcgtctccgctaacgtataattccgctcttgcagtgcccgctcaccagttcgcatttcagccgtgtatgagtcttcctgcagacggtaccgcgtatatgaataactaccaacccccacagcgataattactgcaaacacgatccacatccatcttttcatcacgacacccccatcaactgattttgtaattaatttattataacatgtttacgaatcaggtcgcgattcgttgtgcttacaaaactgttttcataagcgtataataattagtgtattttacgaagaaaggatccttattgcaatgctagaaaaaaccttttaccacacccttctaagccactcattcaatatgcccgtcacagtcaactactgggatggaagtagtgaaacttatggtgaaggcacaccagaagtcacggtgacttttaaagaagccattccaatgcgtgaaattaccaagaacgcttcaattgcccttggtgaagcttatatggatggcaagattgaaattgatggcagtattcaaaaattaattgaatcggcctatgaatcggcagaaagtttcttcaacaattctaagttcaagaagttcatgcctaaacaatctcactctgaaaagaagagtcaacaagacatccaaagccattacgatgtgggtaacgacttctacaagatgtggcttgatccaaccatgacctattcttgtgcttacttcaaacatgacactgatacattagaagaagcccagattcataaggttcatcacatcattcaaaagctcaacccacaacctggcaagaccttactagacattggttgcggttggggtacgttgatgttgactgccgctaaagaatacggcttaaaagtcgtcggggtcacgttatcacaagaacaatataacctagttgctcaacgcatcaaggatgaaggcctcagtgatgttgctgaagtccggttacaagattaccgtgaacttggcgacgaaactttcgactacattaccagtgttgggatgttcgaacacgtcggtaaggacaacttagcaatgtactttgaacgcgttaaccactatcttaaagctgacggtgttgccctattgcacggcatcacccggcaacaaggtggcgccactaacggttggttagataagtacattttcccaggtggctacgttcctgggatgaccgaaaacttacaacacattgttgacgccggcttacaagtcgctgacgttgaaaccctccgtcgccattaccaacggacgactgaaatctgggataaaaactttaacgctaagcgcgctgccatcgaagaaaagatgggcgtgcgcttcactcgcatgtgggatctctacctacaagcctgtgccgcttccttccagtctggtaacattgacgtcatgcagtacctcgtaactaaaggtgcttcatcacgaaccttaccaatgacccggaaatacatgtatgcggataaccgaatcaataaagcttaattaaatgccaaaataccaactatctcgattatttcgaaatagttggtatttttttgaccatttttcaggaatgactgacaactagctttcagtcaccgccatgcgtacccaacccaagatctgatggtagatgagtaacgatcctaggaagaaagcggccgctaaaccggtggatgtcggtagtttgttaaacatattggctggtaacactaaggctaatagtggaaaggcatacgctgctggcaattgtaagttaagcgcccgtaaccacaaatacacaagtggtaaggcaatgaccgtcgttaatagccacgaagcaatcaataggtgaatgccgaccccaatactagcagcagccgacaatgcaagccactgcttaagtgcggtcgttaccgtatattcagactgttgagccgcttcaaagaaaacgacgatcacgggtgggattgcggccatctggggctgtcccgctagccaaacaatacccacccagacaaaaactaggctgataaagccgagcatttgccagcgactagcagaagcttcggttatccgtgagattgatcgcggtcgttgaatccaagccccaatcatcaggcaaatagtccagaaaaagatggctacgataaaggtccagtgcgttgcattaatgataattggcagtaagccagtagcaaaggctggcgccaaattcgattttaaccccttcaataataatagcatcagtaatagaccgacaagcactttgagggcgtacgaccaaggtagttgattgactaagaagccaataattgcagttccagatggtactaagaataactttaagggttgccgagtccacgccgtcttacgataaacccacgtcccggctgtcagagcaccgatttcgggtaaaatgatttccgcatcatgttgcaatgtggcactcgccaccattaatagaatgaagctccacccagctaagtatcgccaaccatcgctttgctttaaatccatttcgacaaaatattcctttcttatatttaattagatatatttatgttatcaagtgtcaacgactagcattgtaccataaatacaatcgtctcctcaaataatcctgaaaacacatcaacagttttcaggattattttcaatcactttcctgacctataaatcaaaattcgactgagtaaagtcttacccagtcgaattcagtcgtcgcgccaacgcagtcgcaacgttatcaacaccacagtcagaaaattatgcattttgcataagccttttgataactaaacggttatgctatttatcgtactagtaattggttaaccagcctacgtacactagccgttacggcctaacatcaaaaatatgaagatggcttctgctactcgtaaccaccaccgatatcggtgccagcgtaataccgaccaatggtgttttagccactgattggcatagtgcgcaatcagtggcgccccgataatcataaaaccctcggtccaaaaatcgacgcgggcgggccaagtcgtgttatcaaagccagcaccaatggtcgcaactacgagcaagatgtagaggccccacaaactgatttgtaaaggtcgtttgattttcggccaccattgccgggcctgtattcgcttaatcattgattgatggtgcggccgataatgctcatgaccaggtaacgctgctaacattgcagtcgcactttgatatcgttgctgtgggtctaaggccgtggccttcataataatcggggcccatgttgaatcctgtgtcagtgtcgttgtatctaacggcccgctcggctcttgaccagtcaacaaacagtttagaacgacccctaacgaatatagatcgctccgttgatccgtttgggcgaagccatagttttcaggtgcggcaaaaccgctcgtgcctaataaacgagtatcactgtcttgctcagcatgatattgtcgcgctgcgttgacgtcaatcaaatagtagtgatcccgataacacatcacgttacttagtttaaggtcccgatgcacaatttgttgttgccccaacgcctgtagcgttatcaacaattcttgtgcgacgcgcaccgtcatttcgggggaaaacggtccttgtgtggccaatcgatccactagtgtttgaccattaattaaggtctcaacacttacaatgcaatcagtcgccgttaataatgcttcgatccggggcattcggggaattggctgctgcttcaaacgctgtagaacaggaacattatcaggatttactagtttagctaccgaaacaacctgttgcttcttaaccagtaacggaaactcgcgttgcgcaactaatggtcctagtggttcataaccagccgtacttaacaattgcattgcttgaacaatcggtaacaccgtgacacccccctttttatcaaaattactaacttttatcataaccatacttttggaggaattacaatgtcaaaatatcagaataacgaagtcacaccagtcgcacaccagtcgcgaacagccgaattagttttaggaattattggcggtatcttcggtatcattgccggcttactggcgatgaccatcggcggcatcggtagtgctttagaaaccagcggatcggctggggtcagcaatcttggcgttggctgcattattgtctctgtcctcgcgattattttaagtgtcatgattaatcgcaatcacgttttaatgggctggttgatcatcctttgtgggattcttaacttcgtctttgtcagcttcttcgggattctaagcggtctgctcattgttattgcgggcggcttagcactaagaaagtaggtaagctcatgcaaaaaacgaaagcttggtatcaaaaatggtgggcgtgggtcctgattctccttggcatcttctttgtcatcagcctcgtcaattctccacaagacggtaaaaactcacaagcagcgacgaccaaaaaaaccagcgctagcaagtccaccgctaaggaaaccccggcaaatacgatttataaagtcgggcagacagccaccatcgatcacgtgcaagtaacggttaataatgttaaaaccgcaacgacgctcaatgatgttcagcctaaaactggcaatcaatattatacggtcaccgtaacattgaaaaatagcggtagagataaagtcagctataacccgtttgactttaaaatcaaggccgccggtaaccaaactagcctagatgagatcaacattgatgaaaataaccaattagatagtggtgacctgaccgctggtggctctgtcagtggtaccatgactggtcaagccaaagcagatgggtccgttgaactcatctacaatcccagctacttcagtgatcggcatttgacctttaaattacagtagtttctggtacactaatactaattaagaaggagtattaggggggcgctaaccgtggtagaacgcgcaactaaggaactatttaacgaaatcaaacatgcaagtgaggccgaccaatttatgacaaatatggccaatagttttattcgtaccaatccggcggaatacctcgccgagcttattcaaatcaaacacgtcactaaaagccaagtcattcggcgcgctaatctaacgccctcgattggttaccagtacttcgatggcaagcgccgacctaaccgggctcgcatcatcgccctcggattcggttttcaactgaccctgactgagcttaacacgatgctcaagcgaactggttacgccgtcctttatgctaaggatgaatgggatgctctggtcatcttcgcacttagtcagcgctttgatcttaatcgtactgatgaactactttatcaatacggtctaggtacgattaccgacgaagattagcgtagttgccatatagactcacgccagctaaaagttcggcataaccaggttttagaataataaaagaccaggccctaatgagttgaatgctcattagggcctggtttgctcaatctaggtcaaagataaagatgatggtttcaatcaacacaatgaacgggatgtatcgaacaaataagataaagtaccagaaggcctcgttaaaactcacaacattgaatctagttatccctagaataatcaaacaactaactagtatcaaaatcgaaaatagcttttttacccttaatcgtttgccaaaccctgaccccataattacagccagcaacagcccacagctcacatacccagtgagctgattactatccagcttaaatccaacctgaacccccgtcgaaaagtaaagtgccgcaatgtatatcagcaagtaaatccctgcaataacttgaattcgtctgtagctattcatatgtctccccaatttagcagttcttagaataaaactatactaaaaggaaaccaataagcctatgcttttttcagctatgtagcacctggaattaagcatcgttaaaataaaaaatcttcaacaataaatatttcaatcccggttgttcaactttagaaccgtgcgcaaggccgattaagaagctacagccaggcacgctcaacggcactatcttacgcatccacgtccgctcccaaaacagataagcactgttccagctgtagctggcaaattcttgattattaaattaataatattcaatttatacattgggattaactcgtttataaccgaagacagattgtcgaagtgctaccgctgctttctgaaaatattttttaacacttggacgctttgcaccatcaaaaaagaccaaacgcattgcgcctgaccactaaaatcaactcgtagtgaaggtgataaatacctcgttctaaactggcgcaatcaaataatacccgccactaagtccaatgaacaagtagatcaaatgccggactgtcgtcatgggtagccgcggcaggattcgtgccgccagcgccgtcccaatgaccgcacctaccataccaatcataatatgggggagcaagactggcgtcagaataccgttcagtacgcggactgtcgaaatatagaccacatcgatcaaaaagaaagtctgcaaatttcccaagtaatccgcagtcgtatcggcaagtgatagaaaataaagggccatcagcgggccgccaataccgaataacccattgaagaaccccgaaataatcatgaagagaccggctaaccaccacggataagtctgattcgccgcacgtttgctcagactaaagtacccggctaacgaaactaacagcgcacctaataaccgtcgcaataattgcacatctaaaacttgaccaagatgtaccgaataggccgccacactggcataaacgataaacggcacaataatctgacgaaagtggatatgctgatgataacgccaaactaatgttatgacactggctgccataataacgcccgccacggccgcactttgagcaatcggaaacaactgtggtaaaaagatcatcatgacgatggccgcaccaaagcccgttaacccttggaccagaccagccaataatccgggtaagaaaaccaataaccataccatcaacgtatcctcttttcatcataataaaaaagaaccgggtcacccagttccaacaaaatctaaatatgaattagtaacacaaaaatcatcactgagactagaccaatcaccactgataaagtcattgaacgcgtgcgataagccacaaatccaacgagaatagcagaaataatcatccccagattgccagaagtgatcactgcgtacttactatcgataaagacacttttaacaactaacgccgtgaatagtgagacgggtacgaaccgcatccattcattaaaccattctgggatcttccgcttcgtaaagaacagtagcgggaaaaagcgtggtatgaaagccacacacgcacaaaaaatgaccaaccaaaaatggtccatactactcattgagctgactgattgcataagaaaaacccctctgtgccctacttgtcagattcttccatggctgtttggccagtaggatcgtgaaccttatagagtaaatgactttctggcttatgtgccaacaagtaacgttcaataaagtaaccggtcaacgacgcgagtagtgttgacaccactaggcccagcgtactcttcattaagaccagaaaacctatcgttagaacgccagacaaaactgccactaagataatcaagcggctcttagtttgcataattgccatataaatgaatagtgccgtcagcgcaaaatccaccacttggagattaatcgtcaatgcactgccaatcaaactaccgataatattacttaccgtccaaaataataacgaatagtgttcgaccattaaggcctgggatggcttccaatgcttgtccgtcgcaaactttaaatagttgaccgcgtaattttcatcattcatcgaaaacgcaaacgtaaaaatgaacggtaatgattgccccttcagatagcgcgataagctggaacctaataaggcgtaccgtaactccaagaaaaacatcatcaaaataatggttgtcatcggtgcattaattgtcagcatcgatgcaattaaaaattgggcgccaccggaaaagaccattaccgaaattaacgccgtcagtagatggttgaacccggccgcatgcaataaaaccccacaagctaacccgatgggaatatagctaagcccaagcggcattactgttcgtaataccactaaccaatttggctcgttctttttcaccaagaatgcctccagtaccataccagtaaagaattctagcaacaacagcgagcgtcaaattacttagacactcggacttaattttaacatgttttttattgcaatcctacaccttgttaagtttttaagtgcatgtaagcggtatcaacactattttttacttgaaatgttgtcccagaatcactaagtcattcggtcggccacctaattcagcgacttctggcagaaacccccactgttcgtacccaaactttttgaacagcttaatgcttggaatattacttgaaaaaatataagcgataatcgttgttaatcccaacacaggtaattgtttaggaactaatgtcaaaacctggctaccgattccctgtccttgaacactgcaatccaaataaactgaaatttcagtcgtctttgcatacgctgcccgtccataaaatggtgacagactaacccaaccgaccactgagtcgtcctttacaacaacccacagcggatagtgttcaggggtatgactcaaaaaccaatttcgacgttgctcaaccgtaactggtttaagatcagccgtcacttgatgactgggaatcgtttgattgtaaatatctacaataatgggtaaatcagacatggttgcagttcgtaatgatacgctcataggtgactttcactccattcggtttaactactgttatcagtcttcattatacagttaatcgtggatcatgctaacaaattctacataaatggaaccgcaatttatccgcaaagctagcattcaaatattagcaaaaaaagaaagaacactcaaactggaacgcttgtagcgaatagtcgaagtagtgactaagataggcacacggcctaatttagggaataatttttaacaaagcacctcataattatcccgatttaaacgttgcttttttagcatcgccaaatgaagactattaatactctttttatcataacatccgcagccgttcaacttggtcatccttgacagtgcctttttgaaattactctggatgctaattatttttaattagctaaatcagtggcacagccctggtcattagttgcctgtcatgaatcactattgccaacaaaaaaatcctccttgagcaggcaagtctcaattactagtttgcctactcaaagaggaatatatcttttaagaaatatctcgtagcgtttactaagctaatgcacccacagaatccaatacactaaccgctataatttagttgaaccagctcttaaccccgcgccacatccgtacaaagatatttgctttgtcgatggacttcttaggcgttacattgatggtcatattcttactagtcgttccgtcaactgccttgatagctttcttgcttaggttcaagttaacagtaccgacagtcttgccattcttaacgggtgcttgtaatttaccatcggttgtcgccgacttcttcaagctaaccttaccagtaacggcactagcatccgtcccggttggcaagtaaatcttggttgcaccactatttgaaacgagttgcgacgttaaggacttcccatcttggacatcaacggctttcacaccattgatcttgccattcttgttaatcgtcgtagtcgtgtagttgtggtaaacatatgacatgatttcagccgtttgagtgaaacgttccgtcccactatcgttagcggcaccggcatgcatgacgaccgtaatgatccggttaccattgctaaacttaacggtcccagtgaaggcattcccagccttagtggaagtcccagtcttcaaaccatccacaggaagtgcggagtaatgtttaactaatcctttgagcatgtagtttcggttatccatcttggttgctgaactagtgcccttttcaaaccaagcatgggcaatgctagaagtctttaaaacttctgggtaatctgataatagcttttgcgcaacggtagcaacatcttgtgctgacatttcgttttcagcactggcggcaacgttactgtacccaattgtgctgccaacctctttattggttaatccactggcattaataatggtagcgtccgtgatcccccatgatttagccgtcttccgcatcaagctaacaaacttatggggcgtcccggctaccgcgtcacccaaggctgtgatagcggcgttagcggaatagatttcagtcgcgttatataattgccgcactgaatacgtcttcgttgataataatggtacgttcgcatattccgtgttttggctcatcttagcgactgccttgctaacactgattttttgattccaagacaacttaccttcatggatcgccttaagcactaaatatgtacttaacatcttcgtcattgatgcgatcgccattggcttactactgttcttatcatacaggatctgaccggtcgacgcgtcaaccgcaatggcggctttcgcagagatcgatggtgtactggctgcttgggcctggaggtcagcccccgcaatgcctaaaccagctgtactaaacgtgactgccgcaacgagggcaatcataactttctttaactttcccgcaaatctcatttctcaattatccctttcttaattgctaatgctagttttagtttaaataattatgtctgtggaaacaagttaatttatcatatccgattgtttttttgttaatgggtggtcatgtttaactggcaaatgaataacaaagcttgtctgctcatcatcactttgcgcataaatatagccaccgtggtgatccacgatactttgggcaatcgctaagcccagtccagaacccccggtcgccttagaacgcgattcttcaacccgataaaaccgttcaaataagcgtcccaacgactcagctggaatacgctgaccatcattcgtgacgtgaatcacgacttcttcaccacgttgttcagcttgtaatactacgtttttagcaccagttccatatttaaacgcattagtgatcaaattgctgaagacccgccccagcttttcagcatcggcttcaatgtaaataggctgcgtgccactttctacttcaatcttcagatgcttcttgttcgcttccagctcaaagcttgccgctaactgttctaacatggccgtcaagtttaaccgattaatggccaacggtgtctctgtctgccgtgatttcgtatattcaaacagatcttcaaccagtgacttcatttgtgttgccttcaaataggcaatatgcgcatatttaattaaatcctcttctgattggtactgtttgttctcaattaagcctaaatagccgataattgacgtcaacggcgttcgaatatcatgactgacattcgtaattaacgcatccttagaccgctcaatttcccgttcctcgtccatcgagtggattgccgagtctactaaggcattaacactttcaacgactcgttgtgtatcaccagtcagattaaagtcaatccgatggtcaaagtggccggccgcaatataatgcaactcactaataatatgtcgtaactgcatctgtttgtatcgtcgaattaatcgccaatataatacgaaaccgtccgcaatcagcatcagtccaataaagatattttcataactccatagctggtagttattgggaccaatggtaatcgatcgtttaatttggaaaataccgctctgtaaccccggattatgtgcaatcgtactgttgatcagtactacgatcgacaagtttaaaaggagtagcaaaatcaccgtcactaccccttcaaaaaataattcacttttttcgcgtcccgttaatttcaaaagctaaccctcactcttaacgcgattcgatcttatagccaacgccccaaacggtctgaatgactttttctccatccgtggcttcttcgatcttatcccgcaaatgactcacgtgcaccatcacggtcttagctgagacaatactttcttgctgccaaacacgttcaaaaatatcatcagctgaaaagacccggttaggatgacttgcaagcaaatacaaaataccaaattctaacgcggttaattgaatatccttacccgtcaacgttttaacttcgtgcgaatctttattgatcgttaacggtccaatgtccaaaatatcaggctcggtagtcgtcacgttattttcggaacgtcgtaatagtgacttgacccgtgccataatttcaagcggattgaatggcttggtgacgtaatcgtcagctcccgtaatcaagccctgaatcttgtccatatcaccagtcttggccgacaagactaggattggaagttgggaatctttccgtacttctttgatgacctcaatcccatccatttcaggcatcatgatatccaaaatcattaacgcaatatcaggattcgtatttaatttagtcaaagcttcacggccattataggcgctaattggttcatagccttcgtttttaatataaatttctaatagttgtgcaatttctttgtcgtcatcgactactaaaattttcatcttattttctccttaaataattctgtttttattttaccaaaaaagcggccgggcttggcagttaacgattgattttagagaaaacgcaactattctgcgtcatcatttgccgtacggtgaactaataaccaggtatagtatccacctactaagatcaataatcccgccgcaacccatatcgtccgtaatgtccaccaccgctgcaatatcgccgaaacaatcgcgcccgtagcaaagctcaacactaattcccaatacactaaaccagtggtcagctccgtgcgcacgcctgtcagccaataattcgtcagtgcgatcgttgccttcttgagattaccagtagagaacacgttattatagccgtggccggcgattgcgctgaaggctgtcgtctgcatcgccatcacgaatgcgagtggtgggaccaccatcgcattactaacagtcgctggtagcatgccgaccattaaacaaacaaccagctctgccaccaaaacgggcaagcgccagtagtgtgaccgcgagcccaaccattgtttcagtatacccacgacaatcacacctagtgtaaaaaagaggactgttgctaatttagtcaacacacccggtaaattccactgtgccacatcaacactgagaaaaatcaaattacccgtttgaccagctgctaagacaccaccccgttggatgaatgtgtatgcgtcaataaagccaccgatacaggttaagcccaagccaatttctcgtaactggaataaatggcgtgactgaaaccgttgcatctactcacctacttaatatgttgaatttggcacctcactaaactggtacaatacgttttaataagtccatcatagcgcaattaatcatcagtacctaacgaaaacgcgccttttaacccatgacaggttaagagacgcgttcataatcatcacatcattgctgatgattctattgttagctattttgggtggttaaataatcattaaacgctggtgcgaaatgggcatcaactaccttaacgtgggccgctttgaaaactgaccgaatcgtcgcaacttgcgtctgcttgtccatcatccgctgttgctggattttttcacgcaaataatttgtcacatcaatctgcttaccgctatcatcagttacagccgcagtcttggatcgacgactgacaacgttgataatttcataagttggtttgtctttcgtgtcggcagttgccataactgttttgaccggtttcgtgacatagtgtcccactcgtagtttagctgtggcctgtacaattgctggtgctagagtttgattataactgtcaaactgcgctaattttccagcagttgtgtgcgcttgtcgattattctgatattttcgcacttgcgaatcaaagctagcacccgcattcagttcagcaataattttttgcgcttgcttctcattggccgtcgcaatgtgttgaaccgttgtcattggcatataagctgctcgggctttttttagttgcgctttagtcactggatacttagcactaacggctttctccatcaataaattcgctttgatttgcgattttaaacgcggttcagtgacatgattacgttctaaaatcatgtgataatttgcgcccgcctgccgtttgaatgcttttaatttagctgttacttcagcttgtgaaacatgatatcgttgattaaggactttgtttagagtcaattcttgaacagcctgttgcgtcgtcgcttggttttcaatttgtttaaatacttccgcttgtgtgacctggccagcatctgacttgaccaatgtcgtagccttcgcttgacaccctgttaacatgactgcgacgactagattcgcacctacccctattaaccgatacttcatttatattagcccctttctttgcatcactaataccacgatatcattaaaaatctaatgaacttaataagtaacacaatcgtgtacagagctagtatcaacgtcccaacaagaaagaaacactacggtcaatctacacgaacgttacatctgcctatatcttccgctggtactcaccagacaaaaaaacgtagaacaaagttgatgttctacgcttacttgatgcttattcaactaaaccaatcagactgactaatacgatatcgtcattttaaccgttgactgaatagttcggtgcattctttgtaatttgaatttcatgtggatgtgattcgcggagcccagcgccagagatttcaacaaactgggcgttttcaatcaaggcatcaatgtccttagcgccaacgtagcccatgccagaacgtaaaccacctaacatttggaagataatatcatcaacgctgcctttgaatggcacacgtccttcaacaccttctggaactaacttgttcgcttcgttcacgccgccttggaagtaccggtcagacgaaccatgagcttgtgacatcgccccaacggaacccatgccccgatagaacttgtattgacggccatcgtcaaagacaacctcacccggtgcttcggctgttccggctaacatactcccaagcatcacggcgttgccaccagcagcgagggccttaacgatatcaccggaatacttgatcccaccatcagcaatgatagctttgccgtattcgcgagcaacgctggcagaatcataaaccgctgttaattgtggcaccccgacaccagcgacaatccgggtcgtacagattgaaccagggccaatccccactttaacaacatcaacaccagcttcaaataaagcacgcgtgccttctgccgtcgcaacgttaccagcaatcaatgtctgcttagggaagtgggcccgaatttccttgatctttcgaagcacaccagcggaatgaccatgagccgtatcaataacgatggcgtccgcaccagcggcaaatagggcttcagcccggtcaaaggtatcactagtgaccccaacagccgcaacggccaacaagtgattgttggcatcaacggcagcgtgtgggtgatcatcatccttaacgaccgctttgatcttcttaacttcttcagcctgcgcttcaatgcttaagttcttatggataacagctaagccaccttggttggccatcgcgattcccattgcggattctgaaacagtatccattcccgcactaataattggaatattcagctgtaaattatcggcaagtttaacacctaaattgacttcattcggtaaaacatgactttcggccggaattaatagtacatcatcgaacgtataacccttttttccaaactttgtatcccaattagacattgaacgttagctccttatgtttttatttttatctgtaaaggtaacaaaacatcgcgataaatgcaaggggttgcgcagattttcagaaagttcttattttaagcctgtaacgcccaaccgaatgttccaggttgggccgagcgtacttcacacacaactttcattcagtcattacatccgtatcaccagtttaaaagctaactaggtgaataacaagcaatgaccacttgcaatcgacaaaaagacaagccaatgcacgccatcagcttgtctttcagtccgagcctaaaacatgctcgtcgtaatattaaagcgccgcttcaaccacatccgggcgaagaagacgacgacggcaatgatcaagtacgcgattcctggtaagaccgggttcaatggtccttgaatcattgacatggttgtaaagactaacatccaaacgatgatagccagtactgaccacgcgattttcttccataacgaaactttcttgccatctttagcaggcattaagtattcgaataacttagcaacgcccaaaccaccaatggcggacgtaatcagaatagcggtgatcccgttggcaccagctgaattcttagtagcgttcgtgccgatgaagcccatgatcccgtacattaagcagaaaatcatgaatagcattaagccattatccagcgccgtgacccaatagttcgccttttgacgttctaccggtgtcttttttggattcacaatctcttcggtccgttcttgaacggtcccgtataattgacgagccgtggttccccgaccttgttccgctaacaatgtagacgtcatttcattcagaactgccgtctttttctcaccactcaacgctgtggcatcaagtgacttgcgcatctgacgcatatattcagcattgcgcttcgtcaactcagtcgcttcgtgaactggccgttctgcggcttgagcctgcttggccccggccgcggcgttcctaggtgtctttgaagtttcgctctcactcactatacaattgctcctttcagcttaaacgttgaagcggaattcgacgatgtcgccatcttgcatgacatagtccttaccttccaaacgcagcttaccattttccttgacctttgcttctgaaccggcttcatccaaagcatcgtaagacatcacttcagcccgaataaatccacgttcaaaatcagagtgaataattcccgctgcttgaggggccttagtaccgcgtttaaacgtccaagcccgggtttccttaccaccagccgtgaagaaggtttccagtcctaatagcttgtaagaagcccgaatcagcttattcaagccaggctcttcaacgccttcagctgctaaaaagtcggccttgtcgtcatcatctagttcggcaatttcttcttcagtttcagcagcaacaccaatggcttgggctccttcttgcttagcatagtccgcaaccacttggaaatacttagagttttctggatcggccatgtcatcttcggcaatattggctacatacagcactggcttagacgttaataagaataagcccttgacgatttgttggtcatcttcgttgaattctagtgaacgcacgggtttgccggcttccaaggcaggtttgatcttttgcaaaacagcgagctcagccttagcttctttatcgctccccttagcagcccgttgcactttagccaaacgcttatcaacagcttctaagtccgctaaactcaattctagattaattgtttcaatatcatcttgcggatcgactttacccgtcacatgggtgatattttcatcatcaaaggcccggaccacgtgcacaattgcgtcaacttggcggatgttttcaaggaacttgttcccaagtccttcacccttactagcacccttgacgatcccggcgatatccgtaaattcaaaagtcgtgggaacgaccttctttgcggggatgatttcttgaattcggtctagtcgtttgtcgggaacttcaaccatcccaacgttggggtcaatcgtcgcaaatggatagttggccatttcggcgcccgccttcgtaattgcgttaaacaatgtggatttaccaacgtttggtaacccaacgatacctgctgtaagtgccatatcggttattcactcttccttttttaataattaagcttgatcggctttgctttctaatacctttttgagttttttattgaactcacgacgcggcatcatgaccacgtgaccacatcccgtacatttaatcttaatgtcagcgcccatccgggtaatttcccagcgattgacaccacacggatgcgcctttttcatctcgacaatatcacctaaatcatacatgcgcaacgcccctttataaattaattaatttaaatcaatactgagaatttctaaaatccgtgtcaaatcttcatttgacaagtacggaatttcaattttcccttgatcagctttgttcgccttagtttgaatcgaaacggccgtcccaaacttctcttgtaattgttcttcactcgcacggatgtacggtgacttcttgggtgcaacttttttggccggctccttggactcgccgttataacgcgccacgatttgttccaactgacggaccgtcatgttatccttcacgacgcgcttcgctaatggcgctaacttggttttatccttcaaagacaaaagcgttcgagcttggcccatggacagttggcccttttggatatactgtttgaccccatctggcaagcccaataaccgcaaataattagcaatatatggccgactcttgcctaggcgctttgagacttccgcctgcgtcaacttcagcttcttcatcaacgaatcgtaggccgcagcttcttcaagcggagttaaatcttcccgttgtagattttcaagcaccgctacttccatcatttgttcttcggtaacatcacggacaatggctggaatagtcgtttgatgagcgagcttcgacgcccgaaaacgccgttcaccagcaatgatttcatatttattcagctcggcatccggttgtcgtacaatgattggctggaaaacgccggacttttcaatcgagctggcgagctccttaagtgccgtctgatcaaaagttcgccggggttggtacggattggcatgaatatccttaagatctagatcaaccacggcttcttcactagctggttcgttaacctcggcaaacagggctccaataccgcgtcccagcgccttattatctttatctttacttgccatgagcggccaacacttcctttgctagagctaagtagacttgcgcacctttcgaacgggcatcataatcgacaatcgataggccgtggctaggtgcttcagataaccgcacattgcggggaataatcgtcttatagacggcgtccttaaagtatttccgaacttcttcgttgacctgggctccgagattggtacgggcatcgtacatagtcaatagcacgccttcaattcgcaactgtttattaaaatgtttttgtacaagcttgatcgtattcaataactgactcagcccttccaaagcatagtactcgctttgaaccggaatcaaaatcgaatcacaagccgtaaacgcattaatggtcagcaagcctaacgacggtggacaatcgatcaaaatataatcataatcatccttcacgtcatcgatggcatcacgtaagcgggtctcacgtgccatcatcggtgtcagttcgatttctgccccagaaagctgaattgtagccggaacgatatctaaacccttatgactcgttgggataatggtttctttaatgggaacgtcattgattaaaacgtcatagatttcacgttcgatggtcgacttttgaacacctaaaccactggtcgcattcccttgcgcatccgtgtcaattaataaaactttttggcctaattcgaccagactagccccgagattaatactcgtggttgtcttgccaacgccacctttttggttagcgagtgcaattacggttcccataattattgatcaccccttggttgattttttggaatttcaatcgtaatccgatacccgtcatccgtatcctcttcatgggtcttcacgggtaagccggcatcagttaccatcttaattgattttttgatcgtattcacagcaattcgcgtatcgccggtcaacccccgtgcacgtttgcgtttgggcttcggcggcgtttgggtcttcgccactagctgttctgtttctttgaccgtcaattgatcagcaagcacccgtttcaaaaccgcagcctgttgctccacagccaagttgagtagtgcgcggccgtgccgttcgctgatttgtcgctgcaacaacgccgtttgaaccggctgtgctaacttcaacaatcgcaacttattcgcaactaacgactgacttttgcccaattctttcgctagcgccgattgcgttaattggttgagttccatcagttcttggtaggcccgagcctcttcaatggccgttaaatcttgtcgctgtaaattctcgatcagcgccattgacgcggtttcaccatcatccatcttttgaatgatggccggcacatctgcccaatgaagtgaagaaatggcgcggaaccgccgctcaccagcgataatttcgtatttctgcggttcgtattcccgcaagacaattggctgcaataagccgtgatccgcaatcgtagcagccaattcagcaataccagtttcatcgaagacttgccggggttgaaaccggttggggataatggcagtgaccggaatacggacaatttgttgctccgtgggggtcgtggccgcctcggttttatgtttatcacgattagaaccaaataatgaaaatgccattgaaattacctcccaccttacattggtgccgttaacggctgtttcgccggtgtccccggcttgcgtggataccgcttcggtgacggcttcttcttatcaataacaatgatatggcgcggatcagcagtcacgggcaaactaaaggcctcgtcctgaacaatttggccccctaattgttgaacggcgtatgtcccttcagccgtttcagtacgggcattggctgctttcaatgcaatcatctggccgccaattttaacgagtggtaggcagagttcgctcaatactgataggcgcgctactgcccgagccgtcacgatatcgtagctttcccggtgagcagacttcttgccagcaaacgtttcagcgcgatcatggaacgttttcacacccgttaagcctaattgttggactagatcatttaaaaaattgattcgcttattcaatgaatcaacgatcgtcacttgtaactgtgggaacgcaattttgagcggaaccgacgggaaaccggctccagcgccaacatcacaaatcgtgagtggttgatcacgcagcgcaggaacgtagaatgctggcgtgagtgaatcgtaaaaatgtttaagataaacttcttgttccgctgtgatcgtggtcaggttgaactgcttattagtcgtgaccaatagttgaaaatacagcgcaaattgtgccaattgttttgccgtcagcgcaatctcgtgttgggctaacgcttgtttaaattcttctggattcattagtaatagctctccttaaaggggtcacattcgtcctctttttgtgaaacaactcaatgtttcacgtcacctcataactttaacgtaaataacacttaaaatcaatgcacagccccgctgttaaaatcgcaataacccttgaaaagtctgcttttacagccatcattgacagctattctagtttgcaatttttctagtcaaattcatgaaccgccttgaacatctcaccgttaaaaacgacaccggataaaagtatgaccagatgattcattaataaaaaagaggccagccgaatagctgacactcttacgttcaattcaagattaaattatatcaccgactaccaaacgaacaacccaacgacaccggctgatagtaaggagaccaggatcccagataatagcatgtaaccaacattccgtgaaatcaaatcgttcttttcacgatcaacgattcccttgaaagccccaataatcatcccaatcgttgagaagttcgcgaaggacgttaagaagaccgttaagactgcccggaaatgcggtgcaaaatcgttaactttgctggaaacttcacccatgacaacgaattcgttagtcactaatttcgttcccatatatgaagccatttggaaagcatcacttgggttaaagccaagtaaccatgcaaatgggaacatgacaaccccaaagatgttttcaagtgataaattgctattgattaaacctaacaacttatcaattaatttggctaacgctacgaaagcaataacgttagcagcaataatcaaaatcaagcgaccagcgcctaagattgaatcacccaagaaagagaagaatggttcgcgagctggtttagcttccttaacttgttcattagctaattcttcagaaccgctcgtttcagtggtggcagtagtttcttcaacagccgcactacctgagattttcgcaatggtatcttcttccggcttaacatcgaccggattcaagattgcagcaataatcgcagcgtttaagacgttcattggcaccgccgtcaaaatgaattgaccaggcatcatcttaatgtaagcccctaagatcgatgccgtcacacaactcattgacatcatcgcaatcgtcaagtttcgttgtgccttcatctgcttcaattgtaactgcgaaacagcaagagcttccgtgttgcccaagaacatcatttcaacaacgaagaatgattcgaactttggttgaccagtaatgtaagctaagccccggccaacccatttgataatccatggtaatacgccaatataggtcaaaatatcgaataatggcacaatcaacaagattggtaataatgaactagtgacgaagtccatcgacttaacgttaacccaactagctaacgcaaaggcgatcccatcgtatgatacattgacgagccaagtgaagccatctgccgctgctttaaccgcgtcgacaccgacttgtgaacccgttaagaaccatgccaataagacttctagtactaacatgacaccaactgaacgccagttaatggcgtgcttttgcttggagaataagtaggcaatggcaataaaaaccacaatcccaataatattaactaccaagttaaagaccatgtgaataatccctcttccctatgaatgtaagaaatatgacaaaactacttctatctaatttaccatttaatacgcacttgcggtagcactttttaaagaaaagcttaagttcttaattaggccgtaccaatttattgaaaggccccgtccagatagtgctggtaaccgtgagaattttagttatgtctgcccaatttcattctaaattttagtaattctgctaatcatagatcgaaaatttaggtccatcttgattaaccgttaacttattgtgactagaattaatttattaacttagtaatctatctatttccatcataaagacaataaggtctgatccatgtgacttttcttaaataactacccacgcttaatttgacgattaaataagcaatatttaattgtactcaaaccgactatcacccaagcaagcacagaccaccatatactaatgactgtcatcattttaggctgataggataaatcaatatggtttgctccacgtttaccatgaaccattggtgtactaattatcgatggtctcaattctttgtgcgctaacatttcaccattcaaaataacttgtgtattgccataaacaaccactggcacccttatttgacgtgctcgcttttgattccatgtcaaccgcaacacgccacctggtaacacttgatggtgaaatttagatttaggagaaataacatatcggacatacgcactataataatcagtcgacgtcgaataatttccctgaataggcacatagtcaggagtacgacggtccactacctgaattaacgcacttttatctttaacatgaaacactggttgtaaatctgtaatagttttaatttttttaccatgataacggtgggcaaacacattgttatcatttgttcctaaaccagcagcaatactgatattaggatcactttgacgagctacaaaggttgcagcagctaccgctaaagatactacggcagcagtggctacgattgtagttaaaagtttaattcctgcttgagtccaatggaaaacaccgtttagccgtaattcttgtacaactaacatatcactaagaaataggaatgataatccggtaataataaatcgtcgtggtaattgtaaataactctctaacgctggccattggagaccgataattgaccatggtaccagattagttcctaaaacaagatacacagccgccataattgtcaatgttcttgtaaagccagataacgttcgccaaaataaaagcagtgcagcaagtgcaccatagaaaaacaaactgataattggaagactgagtggacctgaatgatctgtaaaaggaacaactgcattcgttacaccatttattaatggcatgtttgttggtggtaacaaatgactacctttaagtagctctaaatatggcatgatgacattcaaacttaaaaccagcgccaataggattcccattaatagtcgaccaagtgctcgccattttgactgtgtttttattaatccaataacaaaaaacggaattagtattggcaagactaatgctgccgaaattatctgagcttgtgcaataattccgataatcacccctaagaagagcatttcacgtaatgtccagtctccagaatagaaagctttcataggaccaataagtaatggtacaaatgcaactgcgagtgctcgccaactcgtgctatacataaatccatatattgaaaaggaagtcatataaatacttgctaacgctacacaaatagcaaaattgaatttcaactttttagcaccgtaatacattgaaattcctgcaaagaagttcactaatatcattgaaacgatttgaaacttaaaccatgtgcccgttactaataagatggctccaaataggaaagtcaacaagggactatagacttgatttacaatacgtcccgcttgttgaaaagaatacaaatttaaaaaactaaaattgccatgtctaatttgcatttcagcttcataaatacgattgtattgaaaataactatctacacccaaaactccaacttgatttaatataattggtaaaatagttaatactgcgatacttaatataataatccatgcacgactagcttgccgccgattccccaccataaaatattcccctttttatttaaaataattgtaacaatatctagcttgctaaaattaattagcaagtttagtactaaaatcccccttaatttttacatttgatgccgtaatggcatgattcgttcattatatcaagattacttaacaattaaaaactctcttacactttaacgataatgttttttggtattacaaataattcataacagtcatagattcccccccttccaaccactatggttacttttgaaattattattatgaactaacattagagatgctatttcaaatcaaatgaccattcatataattatcacctctagctaggctgagaatacaattcacctatcaaaaaagttcgattcgtcattgaatcgaactttttctatcagctcccattttgaataataaaccaatgatgaactgacttgatgacaactgaaaattcagtcgttaagtaccccgcaaccgcggagtgcccctgccaaggaattctattataccgcgtttagtccgtttgcgaactaattagttgacctgaccattaaatgggactaaactacggacaattaatgaaagggggtgatgctttttgagtaccatatgtgatcttaaagcatcagtctctgccctattcggagcacatgactgatacctttaaggagtcccgaccaaatttacttggtcgggacttttgctatctaaaagtgtgtataaacagttgcaagttgactgtgagtggcttacattaaaagtgcagtttatttggagatatggagtaacgggaaatatgaaagcaacgacaaaacaagtattgacaggcgctacctggctagtagttctgctagcaatgatcggtggtaccatgctttggcaacaacaagtccacaagtcaaaaccggtcaccaccataacagtgacttctactgaacgtattccaatggtgctcttactagatgaccacttaactcacaatcagattcagcaattaactgcccatattcagaacagtagtgccactcagacactggtcaccgccaaaattacagcgacggggaccgtgacatttaaaggagaattgctcaacagtgacaaccgcccctacatacaagtgcaactgcccaagaaccttgattcaaaccgacaaacgcatttattaaagcaactcctaaccgtcgcccgccagcagtttaaatttcgccggtttaaccttgtcagttacggtcgtggcggtcttactgccactaactatgtcgaacacacaacaacaagcttatcaccacaacactttgtactgatggccaccccatttaacggtaccagccgccaaagtaacaatcgtcgccaaacgacgccggttgccgccaagtcgcaaacggccacactagctaaattgattgcacaccgccataccattgattccaagatgcaggtattgattgtcgctggaaaagccatcaaagctgaccaacccctaccactgcaaagtgccctggctggtcaatctatcttcaagccagtggtaaaggtctatcaacaaaaagtattgcgctcatggcgcacccaatccggcttactcaacaaccatcaaatcggtaatacgattcaaacgtttataaactgatttcacccgtccaatcgacctagccatcatttttgctcagagtgcttatctaaaacatatctaaaagattaatagccacctttcctgacaaccaacttggtctactggaaaagcggctatttttagctttaattgtgcgatctggtcgtagtaagcctttaacgttaaaagcagccagcttaagtccgctgaaaaaagtttaagttagtgccaaccctgcctggttgagcgcgtcctacaacgccttccagtcgggatagcgttcgaatggcggacatgtgcgtattccgtttctgatgaattggccgtggctattttagcgacagcgactttgccatataactgtcagtctgataatagaattacgactgttccatgatctttatactgaggtattcaaaacagttgatgtcccattaacatttgttcaaagttcttagtagtaaataataatttaacgactaattgcaccagttaggcggtcgttcatctacctttcgagtggcttcccgaaacatgctcaatgccactgaagtctgtgctggctacgccaacgctctgcctaactttgctactgccataacatctgatccggatactccttggtcaaaaactgtttaatagcacgaatcatgatagccgttgaaggagcggccgcctgggttttgttggcaactaaggcaatctcacgattataaggttcggcaaaggaaaacgtgttaacatctccagttagcttccgtagtgctagctgaggcaaaatgcccatgcctaaaccggattctaccattgaaataatagattgatcatcaatcgagaatcgtaaaaagttattagtaacgtggtagtggtccagtgccagcttggtgtcccggtcataatcgctttgttgtagaataaagttcttatccgcaacgtcatcagtcgtgatgaattcaccattttctgggataaaatcagcgggcgtcacacaatagattggatcattgatcagtgaatgcactaataagttctcattgactggcatcgacgtaaacccaatatcgatagtaccgatcttggcccagttggttatttcattaaagttaccttgcatgactgaaatcttaatatcaggatatttatgattaaattcgcgaataattcggggtaaccagttgatacagacactactgaaaccgccgatccgtaccgatccagagtgcaatccttgaatattatcggcaacttgtcgcaagttactttccgtattcagaatctcttgaacatagggtaaaacctgccgcccatcactagtaagttcaacgcctgaacggttacggatgaatagcggaaaacccagttctttttccaactgattgatcgaatgactgaccgcacttggcgtaacgttaagcgtagcggccgcttgatagaatgtatgttgggcaacgaccgttgaaaagacttcatatgcgaagtttgccataatgatttacctctcttaggtgaatttatttcacttattattgaaaaagttgagttttactaattacaagctttattttatcatattgataatcaaagaaaacagtttaagtacaaaaaactgagtgggggaaaattattatgaaaaaattatttgcaaatcgcgtgttaaacaatgacacttccgacctagatgaggtcttcaagaatagtgcaaacccggaaaacatttccttcgctggtggttttccagatcagcacttattccctgacaacgacttaaagcaagcctatcgtgatgctattgaacacgatggtcaaggcattttccaatactcatcaactcaagggttgccggcattacgccaaaaaattgcagatcgaatggcgactcatgctgacgttcaagttagtgccgacaatgtcatgatgacccaaggtggtcagcaagccatcgacctcgtggcgaagctcatgttgaaccatggagatgccatggtcgtcgaaggcccgacttacatgggggctttagccgccttcgacacttacgaaccgacttactacgaaattccagttgatgataatgggatgaatattcgtcaacttcgtaaaaccttgaaagctcatcctgagatcaaattgatttacacgattcctgacttccacaatccaacgggtacgacgatgagtgccaaacgtcgtcaagcactcgttgcccttgccaatcagtacgacgtcattattttggaagacagcccgtaccgggacctccgttatagtggtcaaaatattccggctatcaaacactacgatactgaaggccgcgtcatctttatctcaagtttctcaaagattctctccccggccttgcgaacaggctggattgttgctgacgacgcaatcatgcacgaattggtcggactgaaatccgcaatcgatgttcaatcgccaaatgtaacactggctgctatcaacagctacctagatcaacacgacatcgacgatcacgttgcaactattagtacttcataccggattaaacgtgacgcgatgttagccgcactcgataaatacttcccgcaaaatgtccactacacccgtcctaatgggggcttcttcatctgggtaaccttgccagaaggaattgatgctaaaaccttgctcaatgacgttgttttaccgcaagcacacgttgcctatgtgccatccgcttgccaattcgcaagtcgcaaggttaaaaacgggttccggttgaatttcaccagtctcgacgtcgaaacgattacgctgggaattaaacgccttggccacatcttacaaccggcaccagtaattgttccagcagcatcgttcgcaccccaattctaacttgacccactcatcatgcgactaaccgtaataattgcgattagtcgcattttttgattacatctgtcagctgtaatgagtggtcgtgatcctgaatattagcactttttatatcaggatccacatcaaataagccgtacgctttacgaccatttatactgtatcagtttgagcacccgcgcttgcgtcgcttttactgataaaaaagggtttgacagtccttctctgattcgctacactaacgctatactagccgattatgaaataagcattggtccgtttgcgacactcaatgcttattttttgttaacagcttcattttcggataaactaggagtgttgtgaaaaatttctaggagtgtgaatcatgaagtcatgggttaaaaaattaggcgttgcagtgcttgggttaggtttagcagttacattgaccgcctgtggtagtaacactagcagcagttcaaagtctaacgacctcggattgcaaaaatcggggacgttgacgattggcttagaaggcacttttcaaccatatagctaccgtaaagacggtaaattaactggtttcgaagttgacctcgggaaagccgttgccaagaagatgggactaaaagctaaatttgtaccaacgaagttcgattcgttagtagctggtttagacacaaacaaattcgacgttgtcatgaataacatgtccgaaacggcggcccgaaagaagaagtatctcttctcgaccccttacatttattctaaatcacaattagccgtcaagaagaactcatcgattagtaagattaccgatattaagggtaagaaagttgccgaaacaacgactagcaataacgcaacggatgctaaacgtttaggtgcaaccatcaccccaaccgatagtttccaacagtcgatcgacctcgtctcacaaggccgcgtcgctgggactattaattctcgtgaatccttctatgcttacttcaagcagaatccgaaggctaacattaagctgattgattccggcgatcacattgcctcacagaaaatcggggccatcgtcactaagcaacaccctaagatgcaaaaacaaatctcgaaagcaatccaagaattacgtaaggacggcacgttaaagaaattgtccaataagtattttggtggtaacgttactgataagtaacgtaccattgcccgctattatggcgggatacatagcaccaaattctaatttgttacaggaggctccctatggattcaatctggcacatcattgtcacatcaacgccgcaaattgctgcagcgggtttaaaatataccattccgattgccattatttcgtttattctcggtttgatacttgcgattttcacggccctcgtcaagatttcgactcgtcgtggttggtttttaattctaaaagccatcgctaacttctacgtctggctctttcggagtaccccactgctagtacaactctttatcgtctatttcgggcttccctaccttaaaatcaaagggctctttccaaatggggtccagctcgacccctggactgctgggattgccactttttcactgaacaccggggcttactgtgcggaaacgattcgagcagccattctctccattcctcaaggtcagtgggaagcggcctactcgattggcatgaccaagtcacaagtactcaaacgaattattttgccgcaagctgcgcgagtctcactaccgccactatccaatagttttattagcttagtcaaggacacctccttggccgcttcaatcacgattattgaaatgttcgaagtcagccaacaaattgctgctcaaaattatcaaccacttgtgatgtactccctggttgctgccctatacgcaattctatgtacgattctcagctggctacaaggctacttggaaaagcggacgtcacgttacttacggccacttaattaggaggttgtcgaatgatcaaattagaacacttaaataagacgtttggcaatcaccaggcgttaaccgatatcaatactgaatttaaagaacaccagacgaccgtcatcgttggcccctcgggttctggtaaatcaaccttactgcggtcactaaatttgcttgaacggcccgaacaaggtttataccacttcaatgacgaaactatcgactttactaagccgttgactaataaaacaattctcaatattcgacgcaaaactgggatggtctttcaaggttataatctgtttccccatctcagcgttgttaaaaatgtcatggaaggccccgtgcaagtcttaaaaaaggattccgcgacggctaaaaagtccgcgctagaattgttggcccgggtcggcttgcaagataaggccgacgcctaccccgaacaattatccggtgggcaacaacaacgggtcgcgattgcgcgctcgttagcgatggatcccgaattcatcttgttagatgagccaactagtgcgctagaccccgaactcgaagctggtgtgctccgcgttctactagccctcgctcaggaagaagactccatgattatcgtcactcacaacatggaatttgcccgcgcagttgcggataagatcctatttgttgaagatggcaaaattctgttcgacgggacacccgctgaattctttaagcagccaacgcaacgaattgccgacttcttagccgcgatgacgttcaccacgatttcagacaaagcaaaccaatagcgttcatttgagttaacgtgcatctaactggaaaatcccagtcagatgcacgttttttagcaccccctagcgtctcacatcaaccatcgatctggcgcattcacaacaaatggcatttagattaatataaaatgtgatttcgatttgacaattgttatttaatcttgtagactagcctcaatatctaaacattgtgatgagatgagtagtgtgattgccacgaaaagcgagccgttggttggtgtaaaacggtcggacagtgatacgaagatggtctctaaatggtattggtgagcattagcaagccagtaacgcgtcgtacccgttagcgtactgagtgaattagctcattgagccaagcgttgtgcacgcgcttggaaactaaggtggtaccacgatcagcagtcgtcctttttcgataaaggacgacttttttgtcaaaaaaatatagctctacgggggtaatcgatatgaaaaaatggctcaaggcagtaagtttaacaattttaggactcgcactaacagtcaccttgacggcatgcggtaattctagctcatctaaaagcagcacttctagcacgagtagtcagctcaaattgcaaaaaagcggcacgttgacgatcgggctagaaggcaccttccagccttatagctatcgcaaagacggtaagttgactggttttgaagtcgaccttggtaaagccgtcgctaagaagctcggtctcaaggcaaagttcgtcccaacgaaattcgactccttgattgctggcctggatgtcgataaatacgacgtggtcatcaacgatatcgctgaaactgcgcaacgtaaacaaaaatacctcttctctacgccttatatctactctaaatccgaattagcggtcaagaaggggtcctcaattaacaagatcacggatatcaaaggcaagaaagttgcccaaacaacgactagtaataacgcgaccgatgctaaacgtttaggtgcgaccgtcacaccaaccgatggctttcaacaatcgatcgacctcgtaaaccaaggtcgcgtcgccggaacaatcaactcacgggaagcattctatgcttacctcaagcagaatccaaaggccagcttgaaattcattagtggtggttcagaaatcaaaacacaaaagattggcgcaattgtcactaaaaagcacgcctcactccaaaaacaactgtctaaagcgattcaagaactccgtcaagatggcaccttaaagaaactgtctaataaatactttggtggtaacgtcacaaaccaataaccatcgcaatctatttgatagcgtccagttgatagtcacaaagaaagcccggaaaaccgggctttttttgtgtgttagcgtctttcagcgaccatcttttatcactcattgtgttgctaaaaaccatccgggaccatttacaccattgcttatgtcgtgaacccggtcagctaattcaactgatttgcaatattgaatttcatcttgccatgattgacttccaaccacatatatttggtgttcttaggcgacaaaacctcaatatgtgaatatttttgattgtgattcttcgcgattttttcagagcggctttgcagtgtcttggctagtgactgccacgaagcggtcttgccttgatcgacactttcaataactggcgcttgctttgatatccgcacacgcatggcaccaccattccaactcactttaaccttgccatattcagctttattcgttctgatttctgattgaatattggctgcaagcgtattagcttcccgagcctgatacaaattaaatccaatctcaaagacaatgactagcgcacagataactggtggcaaccaaaaccaccacgtccgtaagctctttttttgatgatgcggctgctttaaagtcgtcgtttccgcgtctttacacttatcctcagcaactgtcggttgtccactgccgcatttttcacaatactgggcactttggggaattcgttcaccacaaaccacacaattcttcatgtccgtttccataattgtcctccgtcataatattatcgataataattaactcagccatgacaattaactgtattaatatttcaatataatgattatatatcgaaatcagtcatttttctaggccttatcagctcagtatagtatcacccttgcgtaccggacagctggtactcgctgagcatcatgattttaagctttagtacgggcctatttcagtcaccgttatcaagcacattttgcgtttactagtggctaaaggtagtttaccttttatcattattttaatatttaagtttgacagttagtttcacttcactgtatactactcattgagcaatactatacgacgtataatatagcaggaggaatagcaatggccattcaaattagttccgagttattggacgggtgcgttttagcctgccttaaaggccaagattactatggttacgcgctaacgcagcgcttgcaagccgccatctcggtgtccgaatcgacgctctacccagtgcttcgacgactcaagaaaaatgactgggtcacgacttacgatcaggcctatcaaggccgcaaccgacgctattatcagattacgagcgccggcctgacacaattgagtgcgattcaacaagagtggcaaacctattatttggccattaaccacttacttcagggggaggatgaatcatgaacgactacttatctaaatttaacgcgttactcgttcaacttaccgatgatgaacgcgacgaggtcgttgaattttatcgcgaatacttgctagacgcggcaatcgccaattatgatgattgcgttgcagaactgggaacgcctaaacaattggctcggaaagtgttagccgattattcgattcgttttaacgaaaatctcaacgccaatacttctaaacggcaaaaatctcaagcaaccgtacgcacgatttggctaattgtgcttgctttattatcaacaccgatcacaattcccgcattaatagttattttagcggtcttctttgccttggccgttaccgtctttgcattcgtgattgcagcgggtgccatcttaattggcgtgaccatcctcgcatttgccatgctaacagccggcatcggtatcttcggccagtcgctatgggtcgcactattctacctaggtagcggtcttgctattattggtgccgagctattagttttaccactatttatctggcttattagcgttattctgcaaggaattgcaaaaatcgtacaaaacctataccaccgatttgttaagaaaaatcgggcggaacgaggaggtcaccaccatgcgaaagacaattagagttggcattattttattagttgttggactgcttctaatcatgtttggaattgccaataacggtattcaaagcgtctattgggaccagggttttcacattgttcgccataagactcggcgctaccacgtcagtcagctaaaagatatcacgattgcaacggccaacaatattactattaagcaaggcacagctgctaatatcacggttaccgccacgcgcgccttaccaactgttacgaccaacaatggtcacgtcactgttacttcaacgacacacaacgccaaaaccgtgggcttcatgttcgataacgtcggacaatttgctgacacgacaataattacggtgcctaaaggaactactattcatcaaataaccgccaaagctagtcaaagtggtaacgtttcgttgcaaaacgtcaccgtcgaccaattgaaaagtcttagtacggatagcgatattaatttaacggatgtcaaagtcaatcagtcgctgacgttgaccggcgataatttacggttaactcgtgtctcggcgcctagtctacaaatcaatagcgatccagatatcagcatcaccgacagtcattttaccaagactgcttcaaaaattataaccgctgatagcgacatccatctaaccaataatcagttcaaagcccttaagctaacaagtagcgaaggtgatattatgctcaataataatcgcatcactgaaagtttatccgctacagccagtgacggtgatattcgaataaccgcgccacggacaaccggtgttaaagctagcactagcgatggggacttgcatattttcaatcatctccagtccgatggcggtgattaccaggtcaaccaatcggcagccgtacaataccgactgacgaccagcaatggtgatattacggttagtgctagctagtccatgctagtactgcacttactcaaattttcaaaataaaaccgcgacttgctcatggctcgcggttttatcgtacttacgtttaggatgctattgcagtcgtcatttccggacgcccttgaatcgccagcagtgctgctcccgactgaatagactgattaggttctgattctatccgttgataatttttactatttgtcacaatcaccatgaccgtgtcatctaagttagcagcttttaacaccgttgcgtcaaactcacctaagagatcacccttttgaacagtttgccccggtttaacgataactttaaagccttgcccttttaatgacaccgtatcaataccgatgtgaatcaacaactcaactccattatcggttgttaggccataggcatgccctgtatcggctacaacactcatctgaccactttgtggcgcatagacttttaccggcccctgttcccgtggcttaattgcaatgccgtcccccatcatcttagatgcaaagaccggatcgttaaccgtactcaaggcaatacttttaccagaaactggtgaaaatatcgtatcatctacaatctttggttgtacttgatcagattttaatatgtccttaggaatcgcaaacatattagtggcaataaaagccactgctaccgtcaataacgagacgaccgtataaatcagcaaatcacgaacattgtaaatatacatcagataagagggaacaacggctagaccatatgaatttgctgccacactcataacactcagtacgccagcacctatcccactggttaaaacggttacaaccaacggcttgaaattatagcgaatcaagacccccgaacaaggttggttctgaaacaccaaatagttgcgaggaaaatgcgccaataaaattagccttagccttttgtgactttgctcgtaaaatcatcgccaaagctacccccagattagcaaagccatacatggcttctaaagtaattaacggattgagcttggtggctgctaatagtgacgtttcgatggcaatcatcatctgatgaataccaactagcaccattaacggataggcggctccaatcaaaaaaccaccaattccaaatggtaggttaatcaacccttcaacaccactaatcatcacattttcaatccagtgtacaaccgggccaacccctaaaatcataatgccaaaagtaactaacatcgttaaaaagggcgttaaaatttggtcgagaacgttagggacgtgtttatgaaagtaatgctccagtttacttccaagaaaaccagcaactaacgctgttaatacggatccttgactaccgataactggaatcttgtcaaaaagcataatcgctttcgctgtaccacccgcaactgaatacgcgttaggcagtgaaggggaaacgagcattagtccaatcacaataccgacaattggtgtacctttaaaatagcgaaatgtggaccaaacaattaaagctggcagaaatgaaaaaacagtccccgttaaaactgaaattactgtattaagacttgccggaatcgcggcagatgaagttccaaacaactgtaaaacctgattgttagtcaaagcactttgtaatcccaagaaaagtccagtagctgcaatcaccggaataattggaataaagattcccgaaagcattgccatgaatcgttgcaatggtgacttctgattatcaggagtcggcgtagtcgtcgtttcctgactataaattgcattaactaaatgtaacttttcaatcgcgtcatacacatcgttaacaacaccagtgccaataatgacctgatactgtcctgaaccgaaaaagactcccttaacctcatctaagtcttcaagtgctgctttatcaatctgcttaggatctttaacaacaaaccgcaaccgtgtctgacaatgagtaaccgattcaacattgtcaacaccaacaatatcaataatttttttcgcaagtacctgatagtttttactcatttgaattcacctcaaaaagaatggcttgatatggttccaacgtattgagtcgataatgtgcgtaattatttaatcgaggtcggccattaggtaacgttaggaataaccgttttgcgcttaagttaacatacacctgtacccttcgaccacgttgataagcaatcacttggtcacaatcacaagtaattggcctaaaatcaccgactattaaatcctgacttaaatttgatatttgccgtaacttaatcaatgactgataaaaatgccaaactgaatttgaatctaattgttcgctttgccagtttaccctatcatgtgactgttttggtgtaatccatggcttggcaccctgattaaagccttgattgacggaatcatcccatggatatggtaatcgcgcattatcccgggaacgagcatttacaaaggcaagtgcctcgcttgctgaatatccctcttcaatagcacgatcataattatcgtgactgctcaagtcgttaaacatggtaattgagtcacgccgtgcattggtcacccccagctcttgtccttgataaataaatggacaaccgcgcaagttaaaataaagtaaggctagtgctttggcaccaatttcattccgataagctggtgtctgaatatatttatcaatactccgcggctgatcgtgattttcaaaaaagttagctccccagccgacattttgaatcgccagttggcttttaaaaattgcgcgccgtaagtccgtcggtgtccacttaactcgtcgataccactctgatccggatgcaatatcaatatctgcgtaatgaaagtcaaaaatcatcgagaagtaaccttttttaccaataaattgtccaagttggtcataactaacccccgaagcctctccaaccgtcaccgcgttagctggtttaaaagtagccgtgttcaattcagctaagaacttttcaataccaggtcgattttcagctttacgtttgactttacctaacccatcaacaccatcaggactaatgctggcaaaatcttgatctttttttatgaatgttattgcatcgatccgaaaacccgcaaccccttttgccaaccaccaattaatcatttgatagattcgtttccttagagccggattttcccaatttaggtccggttgttgtttagaaaagacatggtgataatactcatcctgacttcctggcaataacgtccatgacgagcctttaccaaagtttgatcgccaattattaggcggattgccgtgtgccccacgccgaataatataaaaatcacgatacggactcgtcggcgatttaattgcagattggaaccacacgtgctgatcagaggtatgattgataaccaaatctaaaatgacttttaatcctaatcgtttagttacttccatcaactcatcaaaatcagccatcgttccaaaccgagaatcaatagcttggtagtcagaaatatcgtaaccgttatcaaccatgggtgattgatatattggagataaccagatagtcgtaattcccagctgtttcaaccggggtaacatttggatgattccacgcaaatccccaatgccatcgttattagcatctttaaatgatgccggataaatttgataaaaaacttctttttgccaccaatttttttgcataattactactcctatatctggaatcgattccactttaatcaaaagaaaaaggcttaagcactttttcttttgattaagtctaagcttagatcaatcgctaactcaggtcgttgtaaccggcccaagtgatgtaatagctgatcgaccgccaattgagccattgccgcgaccggttgtcgaaccgttgttaatggaacttgggccaccgccgcaaatggttgatcgtcatatcctatcacggccatatcatctggcacgcgaaaatgttgttgctgtaactcatcaattaccccaacggccacctcatcagaatttgtaaacaccgctgtcgggcgatcactagggtttaaggacgctaattgcttccccaacgcttgtccatccgcaatcgtatgttgttgtgcgaaaacccagctattgtttacaactaactgctgctcttcacaaaaatctaaataggcttgcgtccgcgaacgtccatgatgcgtactgggaaaatcaccacccgtggcataggcaattcgccgatgaccttgatgatataagtatgccaaagcatctttagttgcctgataatgatttaaactgatcattggaataccaatatcagtagcttcttcattcaacagcaccatctgattagcatatgtcgccgacaattgtgccactagttgttgattttcaatggatgccagaatgacgccatccacttgttgctgcttgagtttatccagaaagtgttgttctgccaacgcatcatcatgagtctgcattaccatcacttgaaacccgtatccgtttaactcccattccaatgcatcaaataactgtgcaaagaaggggttagagattcttgataccagtacaccaatcgtattagtgctctgcgcgcgtagctgactcgcaatggcattcggggtgtaatccagtttttcaatcgctgcctgaatttgcttcttcttagcaactgaaacactaggccgatggtttaaataccgtgaaacagtcccaacacctacaccagcctcagctgctatttcactaatcgttgtcatttaagctcaccccctatttggaatcgtttccataattaatataacgacctttcaagtaattgtcaagacaaattggcttttcaaaatgaattcactaaaaacggttgcccttaaaacatttagtccaccattaaaaaatggcagtatcctgccatttcgataacttcatttttaacattccagccaaaaaaatattccaagccagcgtacacctgacttggaatattttaattactgattcagccttagtaatcgctataacgatgcttgatagacatcaaaccacgtcaataatagcgacacaatcaagataccaagcatcgctaccgcgtgccaccatttatttcggacaaatatcgcaatatactcacgaatgatcgcatccggtaagaagaatcgcgccgtccgcgcaccaataccatccgcttttagacctgcttgcttggcaaacatcccgactctaaaggtatggtaattatttgtaacaaaaatcgtgcgtggatttttaacagggccctgtgcaatcaattgcttactaaactgcatattttgcaaggtcgtcttcgattgcgtctccgcccagccatccgttgcaggaaggccatgcgcaatggcgtattccagcatggcttggccttccggaaccgtttcatcaccaccctgaccacctgagaaaatcatcacggcccgatgatgcgtcttgcgttgttgcttctgataaaagcgcagtccacgcatgattcgttgccttagcaatggcgagacacggtctccatctaacaagccagccccaagcacaataatataatcttgtcgcagacggggccaattgaattgataaatcgtcagcatcgtcagatagttataaaaccaaaaaccaaggtaaaaaatgaccagattcggaaataccgtcaaaaaataactcacgggctgcggcacatgactactcaacagattgcctaaaaatggcaaaatcagaatggccagtcccaagtacaaggtcagcatattcgccaacgtatgactctcatgacgccacatgatccacgcattccataagagcaagaaggcttgtaaggtaaaaatcagcccaatcaacaggatcagcaacacaaacaacgtcccactgataatgatcaaccagtggatattgctacctaaaattgtaattgccagcatggttaaaaacgaatagaaaaatagcgaaaaccaaataccgttacctaggcgaaccttatcgcgatgataacgccaaccaaaaatggttccaaatatgagtggtactaaccagccccagtaaaacattactggaactggaacccaaaccgctgcgtcattcacatcaatacccccgcattaagttttatttcagcttccatcataaaggactccccgcgggactgcaatcaggagtcattacttcaactgtttttgttcattatagaaattacggtaagctaaatagcacgcaatgattgaccccaaactagtcgctgataagagcatgaacgtgaccataatttgatacttaatggcccgtactggatcgacccctgcaaagatcaaaccggacatcatccctggcagactgactagacccacagtctttgccgaatcaatggttggtgacatccctgtacgaatcgcctcacgcacgatggcaatcgaagcatcgagtagaccagcccctaacgccaaccgttcaagcaccccttgccgctggtcatgaaactgactattgaggctgcgataagccagcccaattgcgaccattgaattcgacgcaatcataccagaaatgggaatcatttgcgatggcacaaacttaatcgcaccagataggacgagaacgccgagtgttacccccgtactaacaaaaatggctaataacgaaatagctaatgcatggtcaatccccggcccccgttttttcgcattccaagccgcattgaagataatgaagcctatcatcgccagcgttagccacaaattattgactcggaaaatatactttagcaagtaacccacgataaatagttgtacaacagcccgcacgacaccaatgacgatgtccttatccaagccaagtttctgccacaaactaattcctaacgcgacgagcactaacattgccgccaaaaatagcgacgtattattaactgctaaattcatgcgtgtacctccaatctgccagcaaccactttcgctaattgatctgccgcagcaatctctgtcgcgtcatgagtaatcatgatcgttgtcacgtgatcctgctcatttaactgtcgtaaccaggcgtgcacgatttgcttattattttcatccaaaccagctgtcacttcatctaataacaacacttttggcaagaataagatgttgcgaatcagcgcgacccgctgccgttcaccaccggaaagctcggtaatcggctgatgcagggttcgttcggacagcccaacattatttaacgccgttaccactcgttgcgtatccatgacttgcttacgaatttggtacgggaaagctaagttatctgccaccgtctcaccaaataacgtcggttgttggaaacaatatgagacttgccgccgatacatgattgggtcatagctttcaatcggctgcccatcaaaaatcaaggtcccacttgttttagaaatcatggccgcaatgatccgtaataacgtacttttcccaccaccggatggtcccgtcaatgtaatatgagccccagctggaatctgccaatcaacatcatgtaaaatatgttgatcagcgatttgataattaactttttctaaactaatcaatgaattcatatgcccacccccgattactaatttagaatcattataacctgactgttaggcgactttcaaacaatcctcctcagttatcctgtgtctttccacatgctataatggaggttaacacagttcacagaaaaacgaggtcaaaatcaaacttatgccacaatctaatcattattcgcaccaatcccgatcgcacaatgatcggcgccgacaacagccggatgaaaaagtgcaagcgaccgttaacatcggccagcgttttccactgaccattcggcgtttaggcattaacggtgaaggtattggctattacaaacacgtcatcaccttcgtcaagggcgcccttcctgaagaagtcgttgttgctgaagtaaccgccgtgcacccacgttacctagaagctaagattcgtagtattcgcaagcctagtcctgaccgggtcgatccccgcgatgcctatgcgggcgaagtcggtggttttgaattagaacacctcgactacccggcccaattagcctttaagcaagatttaattcgtcaagcactcgaaaaataccgcccagctggttatcgacactatgatgttcggcccaccattgggatgactaatccttatgaataccgcaacaaagcccaatttcaagttcgtttaattgatgggcacgtcgctgctggcttatataaagaaaatagtcatgacctagtcgacttaccgacctgttcggtgcaaatgccggcgacaatgacagtcatgcgtcaagtcgtggcttggctggaggaactccaagtaccgatttacgatgaagaacataattctggcatcgtcaagacaatcgttgtgcgtgaagcggccgccactggtgaaattcagctggtcttcatcacaaatacacccaagttaccgaaaaagcatcaattattgatgaaaatcgctgaaaaactgccaatggtcgtgtcggtcatgcaaaatatcaatgctggtaaaacttcattgatctggggtgaccaaacaacattactagccggcaaaccaactattacggaggagctagacggcctagtcttcgatttatctgctcgggccttcttccaattgaacccgcagcaaaccaagaaactctatcgcttagcacgcgaagctttgaacttagcgcctaacgagacgttggtcgacgcttattcgggtgtcggaacgattggtttatcactagccgacgtggctaaggaagttcggggaatggataccattccagcagccgttgcagatgccaatgccaacgcccaacgcaatcaaatcactaatgctcattatgaatttggtgaggcggaagtcttgttaccgcaatggttagcgagcggttttgcgcccgatgcaatggtcgttgatccaccccgtactggtttagataacgtcttaattgatgccatcttgcaaagcgcaccggaaaaactcgtctacatttcatgtaacccatcgacgcttgctcaggatttacaagcacttacccgcggatatcaagtcgactatattcaatcgatcgacatgttcccacaaacagctcgttgcgaagccgtcgtccgcttcacgaagcgtaattaatttgccactcactgccaatcatattagggggaatcatcatggcagctactgatagtcaaattgcattaacgatgacctttacgttacggccaccattcaagactcatttcttactattaaaagattacgtggcggatgttcgtatcccggctcgtgatgggatgctaacgacgattattgccaaaaacattccgctatcaccggccctagagcaactaaaaacgatttttgatgatgtccaaaacccagtttactggcgcttacacgaccaagccgttcaggaattcttcagtgcgcatcctgaacagcgaccggtcctgccaatcgacttgctgcaagtcatgctcaatacattatctgcccaaggtttgtccgatcaacaattaatgcacattatgaaagacgtttttgaacggctacaaaccaatgacttcaacggacaggcatcacagcgaattttgacgtcgttgaacaataagtaacacgccaccatttatcgctgacttttataaattaggattagataacaccaagttgtctaatcctattttttcggacataaatcaatagcggtaactaactaagaacattctttagcacatcgatgaaacttcattagtcacagaaacttgcactaatactcgtttttctttttcttagccattcattatattccagcataagaagatggtctttcggttatcgaaagcaaacttgttgactttgaagttacatgtgataagctgattattgtaatttttattgctacagcaatttgaaaggatgttttaattatgaaatacgccgtcactgccgctaccggtaaatttggtcaaagcgccgttagtacgctgaatgctaaagttggtgcagaaaatgttttagtaattgctcgtaatcaggacaaagctgctcagctgtttcctgataatccaattcgtatcgggaattacgatgatgtcgactcaatgacgaaagcctttgagaacgttgaacgcgtgctcttcgtttcatcacaacctggtggtcccgttgaccgggccaccgctcataaaaacgtcgtgactgcccttaacaccgctcatgttaaatttgtcgcctacactagttttcccaacgcacaggcagcagtcagcgccttagccaatgatcatcgggccaccgaaaatgccataaaagcgactaatattgcgcacagttttcttcgtaacaactggtatttagaaaacgaaatgggcttcttacaaagtggtgtccataaccaagaaaccttgtactgggctaataatacagctggctggaccttggaacgtgaatatgccgaagcggcagcaaccgttttgatgacagatgcccctcaagaagtgtatgaatttgctgggacacccctcacttatgccgcactcggtcaagcactccaagaagcaactggcaaccaagttaagattacccaagtcagtcaggatgcgtacgtgcaattccttgaaacgactggtctaaatcatgataccgctgctttgtttgcctcattccaatccccaatcaatgatggtgcgctggctgaaaagtcagccgacttagctcatgtcttgggacgtcaaccattggaagccagtgtagctattaaagaaatcttagcgcgctaataactagctagctgtaggtttctcttaaatatcttctacaatacgaaaataggaagttcaacgaacatggcgttgagcttcctattttttaatgattcgtaaatggccttttcattagcgcgtaacatcagcaaaatactgagctaaggttagctgaataccattatgattattatcagttgttactatgttcgctgcctctttaacgggttgtggcgcattagccatcgcaacaccaatccccgctgtctggagcatcgcaacatcattaaagttatcgccaaacgcaatcgtttcagcaggggtaacttgatcatcctgtaataatttcattaatgcggctgctttagttacgcctgccgcaacgatttctaaataagtttctttcgaacgataaactgctaaaccgctaaattcatcacggcttaatcgttgttcaatcgcctgaataatatctggatcggccatgatcatcattttatgcactggcgtcggcatccgttgcaaccatgtgcccaaatccgtgacatggggtgcataaccaattcccgtcgcttcctgctgttcccacgggccattagtagccaccaaccagttattattcgaataaatactaattgaggcaactggccaatcatgagctactaccgtttgcacagcttgtgctagtttagggtcaacagcttgctcttcaaaaacagttagtcgatcattcacatcagtcgtagccgttagcgcgccattataggcaatcatggtcgaattaattcctagttgttgcgcaattccaaacatccccttaggcgaacgtgctgaggctaacaccatttgtgccccccgtgcaactgctgcttgaactcccgtaattgtagccggtaataactgtccttgactgtcgactagggtaccgtcgatatcacttacgattaatttgatcattgattttcctccgttaagttaatcatggctatgctaagcgtagacttatattatgtatccttatagattctactgtagcatgaatcaagtcataaataagtattccagaccatttttcattcatagtaaagtaaaagaaccgataacgttacttgttatcgactctttttacctaaaatatcaaatttttggccagggcgacattaccaatcgttgcagaaccattattagcaattcccgttaaaacaatcaaatgatctaagttcggtaattcaacataattgttattaagctgctcaacgtctcttctaatcactggaagttcagtttcgcttactactgagccaccaataacaattctttcaggcatgaaattaagatatgcatcaaagaccagctgtgcaatataataactgatcaacttaaatacttcattggttcgcttcaattgttcccccggtttgccagttcgagcctcaattgcgggtcctgaagccatgccttcaaagcaccgattttgatgatatggacagacacccttgaagttatcgcctgacataggtatgaccattgtatgtcccatttcaagatgagacataccacctatgaaatgattatcttggataacaccaccaccaatgcctgtcccaatagtaaagtatactagtgaacgcactgcttgtccttgtccaatcatatattcaccataagccgaagcatttacgtccgttgtaaaagtaattggaattttcaaagctgccctcaacatctgtacaacatccgtatgagaccaaccagcttttggtgtatttaaaatctgaccatatgtcggtgaatccaccttaatatcggctgggccgaaactcccgattcccaacgcatcgactggatttttcttaaaaaatgaaacacaggcttccagcgtttcatttggctttgtggtcgctactcgttgtcgcttcaagatacggtagtgctcatcagtaattgctaaaatgaacttagtccctccagcttcaatacttcccaaacgcatgagctatgccccctgattgtgtatgagcaaggtaaccatatcataaggctgaatcattaattgttccgaacatggttgagcctcttccagagcatttacctgaatgaaatgttgttttaataagggggtcaaatcagcagccacaccagattcatttgccaaacggataacaaaactatttggcacagtataggccggatacaacgcgctaattgtgacatgtggatcgagtttcaaaaatgactcgcactctgagatagttggtaatgaatcatcaaattcaacatcccaaattttattgtctaatcgatttacaaataaattcaatttttgtaattgataactaacatcgggtgctaaccacttttcagcaattattgccaatttattttcattcaattgagacgtggaaactaacccaaactcaaatgtatttgctcctaattcttcggccaacggcgttggtgtcatctgatgcccaatactagttgtatcgcctgaagcacgacctggtcgccacagtaaattaggcttaccaagttgaccagtggttgccattaatgtgacataaaatgctttctttcctaactcgtattccttcattcctttagcaattaaatacaggccatcgctagccccttgcatcccgacaattttatcaaagttataaaggttaaccggtttttcaacaaattcttcttcccaattttccgcaattggtaaattacgtgttctttgaaagccgccttgaacttgcgcaactgcagtgtcactttcaattgctgtattaatttttaaccgtaatcgatgatctagaacctgattatcgacagttaaacgacctgccaatacattgtcaccatcagttaaagtcaacgttaattcaaatgcgacatcgtgcagctttggttcgtgactaatcctgtcagccaagccttctggtaactgccacttgccgcttaatcgcagttcttgccttccagctccaacataaatggctacaacgccggctaaaggcaagtcaacctctttgtcgcctcgaagcagtgaataatcttacgtatcaccatcattacccgaatctacaatactaatgatgtttttgtaagttttcccattagtagttgcctgaaagttgccatcgacataattcactttccaactttcattttggatagccgtttgttgctcagactgtaattctggcaaagcttctgcaccatccttaaagtcaattacttggtagcccaacccatcaaactggactgcaacttgtacttgtaattcatagtaaccaggctcgtctttaaattcaaagcctttagccgtttgttgcatgatattttctcgcttagccacataatttgcacttaaaatagttgcttgatatttttcatcaaacataatgtttttcgatgatgttaagaaacggattttcttatatccattgaatgggcgtggatcagtattgaatactagcacctgattggcatccagtttcaaccgttgtgcgattcttttcttgatatagttttcgataccgtctgcaatttcaagaccttgtttgaatcgatggtcaatatcaatagcaacattatcagaaacactgccacccaaactgtcatgcggttgacattctagcaactttttccaaagtttcaaaataagacccttagacacatcgataccacatcttttggcgatgaccatcagtggctcaacacgtcgtaatatttgctgttcgagtttgaaattctgccgtttaatgcgcgaacgtactgaaccaattgtccgatgaactctagcataagttggataccgcaactcgccttgataatccggtaaatcgttgcgttgtcgtaatgttcgcataaacttcggataattgctgatcacaatctgattatgactatatttatttatcttactaatagtctcagatacgttatgaataatatccatttgatcgattcccgaaggcactaggaccgaattattttgaccctgttgactttcaaaatcaattcctggatctagacggtttgcaacgaactcttgtaagtttttcttcgaatccaatgcgatttgaccagtatagtaacctaacggaaaattagcagcatagacttgactatgacctagactgtgccatttaaaataaacagagtccatttgtcgcttaaaattagtgccccgccaaaaaataaagtcattaatgccaacttgatttaagagcattggcaattgcgaattaaatccaaaagtatctggcaaatagccaatcatcattggttgtccatacttttgtttggtatcgttgatgccaataactaagttacgaataattgattctgcatcaggtatcatcgcatcagtctgtgtataccatggtccaacaaataattgattacggttaattaatttctttatccggataacatcttcgggatgcatttcaacatactcatctagtattgatgtctgtccgtctaaagtaaaattagcttcaggatgcgtttctaactccttcaaaacatttgagaacagctgatcacttagcacctgtgcgtcctcagttgtaaaataccattctcgatcccaatgagtatgatttacaaaatgtgcttttgtcataaatgtatcgctccctgttattttaggtaacaaaagccgcactacggctctttaaccattatgcggctcgttttagtcaatctaagcttcaaaattaatgttaatgtcgtcctcattatcatcagtgacttgttcttcgctctgtgtttggttaaagtccacagccaatggtgccagtacaccgataatcgcagcgcaaacaattagaccgattaaataggcccaaccattcgtaatggtgacaaatccataaaccccaccaacaggaggaatcttagcctgagccccaagtaaaatcgtagtcgccgaaccagcagcaccagcaatcatattaattggaattaatttcaacgggttaactaatgtaaacggaatagcaccttctgttattccaataaatcccatgaaccagtcgcttcgtccagcatcaagtaattcatcagaaaaacgatgcttaaagaaagtcgtcgcaaatgcataccctaagggaataccagcaatagccacattaacgatcattgcaggggtgtaaatcttttcagctaataaaacgtttcctgccatccatgcagccttattaacaggaccgcctaagtcagaaccaatcatagcgcccatgataactgctaaggtaatagcacttacaccgcttgtactcatttgtttaatccaggcgacaagtgatacattaatccaagtcagcggttgcttcaaaatgactcccatcaatattgccacaaccattgtagatagcagcggtacaacaactaatggcataatagattcgaacttttcaccaacatgtaacttattgtgacaccaacgtgcagtataaccagctgcaaacccagcaaccaaggctcctaaaaatcccatattagaactagatgctaatgagcccccaatgaacccggcggctaaagctggcttatcgccaatagcatatgcaatgtaaccggccaaaactaaattaactaagccaacaccaatccaaccaacggcttcaatttgtcccatataaaaccaaaaaccagttttatacgcatcaaaacttgtaattccaaaacatagacctatcaacttaggaactgcaactacgagggacccgccaataacaaccggtaacatatatgaaataccagacattaagtagcccttccactcagccaatattttcttcataactcactcctccattcttcattaagttcattttatttaacacgagcagcaaccgctttgctgaccttatcaataacagctttcggctttttaatacacatattaatatcaactcgaactgctggaatcccttcaaatcgatccatcttttcaattttttgatccgaaccaatcaataaaaactttgcgcttttcgcctcttcaactgtaatttcatttttaagtcccattgcaccctgttgttctactttagcttgtaaacctagttcctgcgctgctttttctagcgctttcgccgccattggtgtatgtgctaaccctgctgggcatgatgtaattgcaacaaaatccatatcagtcatcctctttttataaaattttttccgaactattggttaatacagtgtaaacatcctgaactgtttgactttcaagtaatgcttgacgctcacggtcatccactaatgcactcgcaaagttagctagaatctgtaagtgtgcctgctcactattttttggaactagcatagcaattacctgattaactggttggtcatcaaatgtcggccaatcttgaatgcttgttgtagagcgaatgaatagtacagcaggttgccgcagatattctgagattgcatgaggaatcgctataccgtcctgcattcctgttgaagcttctttttctcgttgatacagcgctttcaaaactgcatcttcgttatctgcaaagccaagttcaattgctttatgtgcaataaagctaaaaacatcctcacgtgttctaaaatgttcttttaaaaaaatatacttctgtttaaaaatttctgtcatatttgcatttccccttcactgctgtgctaatgtatcaataatttcttgagcattttgagcctttattaaggccgtcattcgctgcccatcttgaatcaaattatagaaataactgtaaatatcatccatttgtgtttcaaccgtgcgattcagggctacgaaaaatacaacatggacattttcgtgatcccatttaattccctttttcgacgtcatgattccaatcgttggttgcaaaacatggtcgatatcaccatggggaattgcaaatttatcgataatggtggatgcaacttgttcacgtgctaacgctgaattttgcatttgattatcaacatacccatacttttctagccgatcagttagttgaataatcgccatctttttttcagttgcctttgaatttgtgataataccgtttggacttaataatttaacaaatgcgttccgcgtatacttttcttgacgaatatcttgacttaacttttccaataagttgagttcttggtcattcaaaaacggactgacttgaataaccctcgtaccgctcatctttaacgggatagtcgaaataataatgtctgcagtcactgttgaagtcatcaactcattcacagacaaagtgccaacaatctgaacatccggtagtttgtccatgacacgttgctttagtaactccgccgtaccataaccagtgctgcatacaattgcaagctcaacatctggttttaagacctttcggcgctcaatgaacgattcaaagtgcagtgctaagtatgcaatttcatcctcagttagctgtaaatggtattgcttttcaatcgccatcgctaatgctagtgcttgatcaaaagcgacgggaaaatacgttttaacttgattacaatacggattcgtaatactaatgccatttttaatgcgaaccagcgccggacgtaagtgtagcgttagattacgtaataattgattatcataatccgttagcacgctacgtagccagtcgactatcgttcgttcaactaagccacttctatccagatcaatgtacccatcctcaatggccgcgacatgcatatttaaataagcaacttcttcatcgggaatttcacacttgaaggccacgataagcattttaactaatttgttggtactcggagatattgccatagtgtcaaaattctgtgtcgtcgtttgagtaataaactcgccattcttaattcgctgaatcgcaataggtgtatggatcagtaaagactcatattgatattcatttacatcaacttttaaaatcttcacaaatttattcaggactttttgcatctgatttaaggtttgtttattgacatatcgtttcagggactgtggcactttaaatgtgcgtgtcattttgccagtctgttgattttgcttaatctcttgtccccaatatgactgtaatagctgaccaatcactcgacgaacatcactctccgaactgttgaatttaacgccttctgtagtggccgtcagcttcaacccataatccatttttaaaacatttaaatcacgttccaacgtactacgactaataaagaagtggtcagcaatatcatctaataacactggtttagattgctgtgtcaagaatgtcataatactaattctgcgttcttgctcactttggctattatccttcagtatcggaaactcagccaacagtcccttcgtattaccactaaaacgaataccctgtcctcttttcctaacaaggtgtacaccttgttggttgactaccttttccacctcattcagatacttagcaatcgtcttacgagatgtgcccgtatactccataatatcttgatagtgaactatcctttttgacaatatcaactcaataatcattcgtgtaagagttgctggtgaactattcggcgccaaatttatcactccctaacttttacaattcatatgataatgtaaccgtatacattatttaagctcataaaagtacacttgtagctagtgtacctttcataagttattattctttgtgctgtcggccatatacttgaagattgctttagaagtttaatctcgaatcctattgtgactaatattaccccgattttgcgcattatcttacaggaagacaaatcatttactgaattaattaactattgatatcaatcataaaaaagcagcgtgatttcattatcctgaaatcacgctgctaagactatccaattacaatattcctcagaacagtctagtattaactctcattatcaaatggtgcctaactatctggtctcgaattatccttcaattcaaacttaactttatcccccacgagtttgacaaatagttcctggtcaggctgaggatcaaatggtcccaagtcgacaaggatctgaccattatccgccacttcatatccttggtaacgatcggcaagcagatgatagattgtttgggctggtcgcatccgctcatccacctgagcggccgccgccttcaaggtataaccagtctgcaataaattactcatcgcggctgccttgataaccattttcattgtatacacgcgagcctggcccggctcatcctcgttcttaggaataatgtacccctttttttgccaataccgtagttgtcgtggcgagacaccagtcattctgcttagttcactaatgccaatagttaattgtcctttatgaaaaagctcacgtaaatctgcacgcgtcccgttagtcatactggcgactcctttccaaagttgttattgatataaattatagcatggaatttcgtcgcgaccattaactcgcttggaattttccgtgattaattaacttttctgataatttgtttgtaagtaatccagcaatgactgggcgggacgatccataatcagctgataatcatcacttactgtggctaatagtccgcgggcgccaccggcatacatcgaggccaacattggcccctcaccattctgattgtacatatcgctgaaggcttgcaaggacactggtcgatacccgattggttgcccgctcacttgactaagcacagtggcgagttccggcatcgtgtaagctcgggactgtgttaacgtatagattcgaccacgttgtaataaatcaggcgttgtggcgactttagcaaaagcggccgcactatctgcctgactgatgaagctgagggcctgatcagccattggataaacgacgttgtgccgttcaattaattctggcaaatatggcactaacggatccgcgtaaagcgcattccggaccatcgtatagttaatatcacttccagctaatcgccggggcacgtaaccataaaatgctgataatgcaaatggattattcacctgatcggcaatgaaacccatgactaggaaatgatgcacattcgcctgttggactgctgctaagacgttctcaaattcttggacccgcgaataactatcatgacttttactaggaatataaatcaggacatcactgtcttggaaaaatgcgcgtaactgctctggctgctggtaatcaatagccgcaacatgcaaaccttgttgttggtatacctgggccttactgagtgtatggacccctaaatataattcagtggtggcgactaacggtctcatcgcggcaacaatctgttgtcctaaatgaccagtggcacctgtaatcgcatatttcaatttaactcgccctttcatgtaactttattagttacatttaactaaatatcgatatatttgtcaaataaagcggccgcttatgatattaacgtcacccattgccgccattaattcggaaacatttcgtcgctacatcgttaaaattaaatacacagaaagggctaccctcattacaagagcagccctaagaaatgcttttctaaaaatagttaagccctaatttgcaacctgttgaccaaggtgcttcttttcaggcgccttcttaacgtttttgacatcattgtcggaaaagccaaacatccacgttaacgtaaaggcgacaatcaagtcgatagcagaggcaatcaagaaaccgtagaaactaaaatcaagccccttaggattgataaaggaggtcacaccgatcagtgacccggcgaagccccacatgttaacgttaaacagtccggtcaagaaaccaccgacagcaccaccgatacttgcagtaataaatgcccggccgtatttcagattgatcccgtacattgcaggttcagtgaccccacagaaggctgagatcgttgctggccaagcgagctctttaatattagcaaacttagacttcagcgcaattgctaagaccgcgccaccttgggcaaccatcgttgcagaaacaatggcattcaagtaactgtgcccagttgtcgtaatatcgttgacaacaattggaataatcgcccagtgtaacccgaagataactaatacttggtagaagccaccgataattaagccagagatggctggactgagtttgtaaatcgccacaattcctgcagccaatgcgccagacaaagctgtaatgattggcccgaggatgataatgatggctccagaaataatcacaacttcaaacaacggtacgaagatcatccgtaagactgttgggatgacccgcttgagccatggttccaacttacttgctaaccacgcccccgcaatcatcgggaaaatcgagtaggtataggaggcaacgtgaaccggaatgccaaagaagttcgcattgattgccattcccaataagtgacccgtaacctttccggttgttgccatactaacaattgctgggtatgttaagaccccaccaataattcccatgataaccggatcagcccctagcttcttggctgcggtgaaaccaacaaatatcggtaagaagtagaagacggaatcacccatcgcattaataatcacgtaggtcggcgttgtcgcagagacgaggttgaagttctttagtaacgacaaaatcccctttaagatcccagaagctgccaacaacccaatcactggaatcatggatcccgtaataacaccaatcaagctgctaaaaccgtgtttgaccttctgccacggcgtcattttctgccacgttaaccggttcgcttccttctccatcgcaacagccgaagcgtcagcatccccaaagcctgcgcctagttgacccacgattgcatcatacacgtcggtcaccgctggcccaatcaccacctggtactgaccacctgcctttgcaacatcgataacgccctttaggtttcggattacctcgtcattggcctgcccttcgtcctttaagtaaaatcgaacccgggtaatgcagtgaatcacgcttttcacatttaccggtccaccaacttgagcaatgatttgactcgccaattcatcgtacttaccgcccttacccttaatcaccggtgcttcggcaacgtgttctttcaattcaacaacagcaccgacgaccccggcgcggacttcacccagttcgggtgttagtttggtaaccatatccgccgtattcgttacggccatgatcaccgtggtatccttgttcgcactagtaatcgccgctaaatccatcacggccactttttcgccggcctcgaccgtatcaccaacttgcacgttaactttaaacggtggccgatctgctagttcgaccgtatcgataccaagatgaaccaacacttccagaccattgttccccgtaaagccaatcgcgtgcagactcgctgcaaccatcgttactttaccactgattggtgcaacgacctgtccatctgtcggttcaataccaaatccttgccccatcatcccttgtgaaaacaccggatcgtgaaccgattcgagtggcactaactgtcctgcaaccggcgttaataaatgcacttgcttcatagcgattctccccctttgactaatcaataatcgcgttgttaacaaactaatttcggacactggttgttataaaatcactaataattgccaatccatccagtggccaactgtcaggccctcctaactaatcaagtaacgtccttaaccataaaagcgctttcttttataaacataataatagccgcccctattaagtcggtcaataaaacccgattaaaataaggcggttcacttgaatttaggaacttatttaattagtttgccaaactttgtgaagcaagtgttaatcgttgcgttgcaagaaaggaccgttcgaaatcagccgtcgttttgacctgtttaccgaaatcaacaatcagtgcgtgccactcccaagccgtcgttaaatcataatgccacgcctgcataatcagttgttgggcctttaagtagttgctcggtaacggttggttaagccagccgaataggcgccgcaaatacgtgtcaataatgatcgttggctgatgaaaaacgtacatgctaaagtagtcagccgtttcatcgccaataccgcgcagagcgattagttcacgccgcaattgttctgctggcaaggctcgcatcacggtcaagtcaaaatcatactgtccacaccacgctgctaaagcttttaaagttggaactttgcgcgtatagaagcccgcgggtttgactaaagtcgtcagttcagtatcagtcaatgctagtaaccgccgaggctcaaagtcagtggctgcttttaaattagccagtgcgtaatccacgttgcgccagttggtattctgaacgagaataccgccccagagaatctcccaaggcgtctcggcaggtggtattccggcttggagccagtgccggggccccatggcagctaacatctgctgatacagtgtctcaatggtcattgttagccctcctcacatgaattggttaatgttgagaccaataatttgatcttacaaaaaaatagtcgtaacggcaaaacatcaatccgctacaactattgtttacgcttgtttattagtcatctgccaccgtactgcgcttaacagctagcacaatgtcagccttccgattttcaggcttgatcttttcttcaaagtccaattcggcatccttaaacaggttctgaatctcagtattaactaacgacaagtcgcgtgaatccccggcttgttggcgaatatagaccacgtactgatctggtaattcttcaagatcatattccacatcttcgtcattcaaaataacataaatcaacttacgttctttgttcatctgaaacttccccttatcaattattttatccgaattagtcgtttgcggctaactggtgagcaaacttaaggtagtcagccacacaatggtctaaccactcaacgaccttattgtccgtaaggtccacatcggcattcatcttgtcctgcaccgcgctcaacaagaattcatttccaggcagaatctgcatcccaactccgggtgaatctaaaacttgccgtaaatgactctgcgctcgcactgtccctaagggtcccattgtggcccctaaaatcatagctggtttcccaattaacggtcgttcaacacgcgatagccaatcaatcgcattttccaagacacctggaacactatggttatattccggtgtcacaaaaatgacgccatccgcgtccatgaccgtctgcttaaaggcttgcacctctgcgggggcttctagctcgatatcctgatcataaaaaggcaacgcgcccaagttaggaatcgtgacatccagttgatcggcataccgtttctgaacaaacgttgctaacttacgattatatgaggaacgtcgaatgctaccgacgagtgcgataatcttcatcgtgtgaaaaactcctttaagttgtaattacttttagtataccccttttttggtaaatagtcggaaccggttacaaaaaatcagctgctttcatcaaaattttaatcttaactgctgaatattcagtcagtttagcaattccagtccccatccgcgtaactgccattatcttaagtctaattttaaacgaggtgaggcattcattagcaggccagattatttcttgctcatagaaataactaccagacataataatcgaggcagtgctgtatcgccatcacaggattaataaactttcacaaatgtttcttaacttttttcaaaaccaaacgtccattgttagtgtgatgaatagagtctgctatactattgattagagaaattgattggggggttaatcgtgtattatcgtggtgaagcacttgactttttgaatatgctacatactacaggtgccgcgccattaatgcgttcgcgaatcgttttttccagtcagatcgacgtggaacgcttaaaggctgccgtgctcgcttccgcacaaatcgtacccgagattttcggtcattatcaagctgaccgtaatcgtttcgttgttactgatcaaccagtcaaccaagttattcaggaagttcaaagcccgtatagtcctgaaaacactgattttgattttacgaatagtccgcaactacggttatttgtcattcatcacggtgactacgatgtcttacaagcctttatgagccacctactaacggacaatcgtgggtttaaagaatatctgtacctgctcgcacaagcctacaattatgccgatctcacgaatttgcataatgaacggcgactacgcccagttatcactaagttgcaacgtcaatttgcacggccacacggtcatgcacccattgttaccggtatggttaaactaccccattatccgggaattaacttgcggcacggtggtcacgtaatgctcagtagcacgcaattcatgcgcgtccgacgagtggctaaggcccaagacgtcggtattagcgaggccattttggcggcatacgctaaagcactccaagttttaactggtcatacaaccgtgacattgccgtgcccaatcgacctgcgccgcttcacgactgaagatgcgaacgtcacccaaatcgctaatttaaccgtcaatgtttttctgacaatcaaggtagatattgatgcaccttttagtgagctcgtcaatcaagtccacgacttgttaacggtcgagcgtacgcgggtcgccttcctttatcgacttagcaatttacagaaaatgaaccatacaatgccaattacggtcatgcgtaaaatgaccaaacgctggttaccacagcctgcgctccggtataccaactttggtgtcgtcgaccaggaacggcttaaatttcatgacttgacggttgtcaattgcgtcttctcgggtgccttccagtgctcacccgttatggaaattgccgccagcacgtttgccggaacctgtacattgagcttcaatagcaccgggtccgaacgtgactaccagttatccatgaaaatcctggaaaacattcaagctcaactgctagtgtgggcacaagcagatgctcaagtagccacaactgataatgtgacgttgcgccaccaagcataattaagtcaattgataggccttaaataccgaccacaaaaaatcccaagctaaatgagcttgggattttttgtggccgctgttaatctggctatcagtgtgattatggattatttagaatcatccagctaatgacgactagtcatccggccgaatcgtttccgagtaatgacttaactggtatatcggtgcccgtcgtgccaatattgctggtgctttgtgaactttcactaggcaaccagtttgcccacttggggtcagtcgaacatcataattttgaaaactagggcgtatcggcgtagtcactgtcagcggtccagtaacgcgctgtaagccaatctgaatatttgctaggtgctggaaagggatccccactaaattacttaaaaagccatcatataggcgccatagtgccccggcggacggcacccagactggttgtccagcggctgcttgtaattggaatcgtaacgtcacgtactgccgggtcacggtcaactgaatcggtcgaaccttcaaccgagtagtagcggcttttaggactgcaacttgggccaacgcttggggaacatcatagctcgccgcaaatactgggaactgattagtgggtacctgtcgtcctttttccgtagtcgtaagttgccggataactttcatcattgcttcaaggccaagtacatatgcgcgttcgtattggacccgctcaaccggtaatgctggtacaattaattgtgtcattttgccacccccatcaacacgcacttaattatcgttagtttactcacgtcttcagccccagtaaagccttttcagctatttcgttaattaattttgtcaaaagttttatctagtaatgtttctaaattggaatccttctaaaaagtgtggtttaataagggtgaatatgataaaaggaggaaccgcgtcgtggcagaagatatgttgacccaagccttgcagcaattaaaggaccataaaatccgtgtaacgccgcaacggcaaatcattcttaattatttgattactcaccataatcatccatccgtcgaaaccatctatcaggaattagcaactcaattacctaacctgagcttggcaacggtttacaatacgttaaaactttttgtcgacttaggaatcgtaattgaattacaaaatggcgatgctggcacccactatgactttttcggtcgaccacattatcacgtcgtttgtgagaattgtggtaaaattactgacgtttttgaacccgacctccgcagtgtcgaagccaaggcggcggaactctctgggtacttggttacgggtcacaatatggaagtctatggattatgcccagactgccagaaactactcaatgtaactaaaacagctgatttaaagcgattgaaattgacgcacagtgaatagaaccagttcaatggcaaccggctatttagcgcgctggttatcctaaaacaaaaggaacactttcagttttcctgtattagtccctgtcaaccttaagtggactatcacagcctgaggtattccttttaatttatacgataagctggtcttacttacgctttaatcagcatcacaatcggaggacgctttcggaataccaatcagcaattacacgaccggtagccctcaaccccctggccggtattaatgttgtgggacttcttccagcatgccatagaactgtgacttgtcagagaaatcagccatataggccccgttcaatccggccttttgcccgattattcctaagtcgatcattagcttttcttcttcatctggaaagtgtaaccgtcccttaatggctacactacgaatatagtttactaggcgattgactaaggcttctgggttcttagtcgtagtaatttttttatcgacctgcattaatacatcaataatatccaataagtcccccgactgatcagaccacccacttaaccggacgattagtcccttaatagcctcttgagcttgttgtcgtaattctgattctcgctgcattaataaagtccccctctatatgattcggattaccataataatttcaaattataggtatctttatatacacttttattatacacgcttatgattgcattcaaaaaaacattcataaacgtgcaaaaaacgcccatcaacgtaaaaaagtccgagctttcacccgaacttaaccccactttaatttactaattaccctaacgttcctgtccaaacgcaaaatagagccacggtccaaatggttgtacaaaggctaataacaaccagccaagtcgatgtcctcggcgaaatgacttcgccgtcaagacatccgcaaccacaattgtggttgcggtaatctccatggcggcaacgggtaacaaccgttgctttaatttacgtttgatccgtggtggcatttgattgtgatgacgaaatagtcccatattgacgcctcccttaattattaccaacattataccttgttaattaagaaagcgctatcttgattcatacccttgtggggctcgcccgacaaacttagtgtctgggatcgtcaattcatcaataaccgctttcccatgcagtaactggcgcgttgtcacaccgacctgtcctcgatcgattgtaatgatttggtaactactgccctcatgaacataatgatgatgtggatcatggcaatcgatcgcataggccgcagaaccggccaccacattcagaatattatctccaatcaaataacttgaaacagagtgaacgtgaccagagaatacgccgcctaaattatgtccccgaagcaccgataacagcgccggcgtattttgtaaaatcgcatagtgcatatttgtcatcgtcggcccatctagggggtgatgcaaaaatagaaaagcccgctttgtcggtgcctgtcgtagatgttttcccaaccattgtagctgttgtggtgccaaccagcctgcctcataaccgctaacctttgaatccaaaaaataaaagtcgttgttgccaatccgcatgcgactcgcgtagtatggtcccgggtcagccggcaaatacccttcgtaaaacgccgctcgccgatcatggtttccaaggataactcgaacatgacaatcaaattcagcttccatcgtatggatgattgcgtgcagccgctgataatcgtcagcgctaccgtcatgaatcaagtccccggtaaaaacaatcaaatctggcatggttggtaatcgccgaatatcatcaataatattggcaagcttgccccagggatcgtactgctgaccatgtgccggtacttggccgcggggggttaaatgtagatcagaaatctgaataacttgtaaaggacgcaattcgatcctccctctcatactttaatcaccagatggttatctctaatatagcgagctaacgtaaagttttaccaatcttcatataaagtaactgtaaagtttgtgctaacctctctttacgcaccattgaaaagtgcccccacagcaacacctttcaccaatagttcagccatcacccgtattgccctcattatactgaaaccacattatcggcagcacgtgcccaacggctttactgtaagtcttcagtatatccgcatcttatttcgccgtcccccagagctagttgttcttgacatcagcacttggcacatgccacccgtgtttcatactgagctagctagtctgacgcgtaatctcataatttttggttgacaagcccaccttttgccgccaccatgaagataagctttaataacatcatacgagtgagggattattttgaaaaatatgtttgtcgggccccatgtggcccttgctgttccccagccagaagattttgatgagatcagtgactggtacactgacgccgattttgttcgtaaaatggatacggctgccgcccgaccactgaccggtgaagaactcgaacgaacttaccgtaaccttgatcggaataccgaatactactttcacgttcatagtttagaagacgaccacttattaggctttgtcaccctattcaatatcgaatggcataaccaggttgcccaattagccatcgcaatcggtgatcccgacgaacgcggccatggttatggtaccgagacactcagcttgattttgaactacgcttttaacgaattgaatctttacaaagtctgtttggacgtcatcgcaacaaaccccgccgctatcgctgtttaccagaatagtggttttgaatttgagggcaccaataagcgtgctatcaagcgtgatgggcaacgaatcgacctctatcacatgggcttatttgcggctgatttccagccccgcgttactttaaactaattaatcagctcaattagttgcagccaataacttttgcaattataatagtcgcagattgatagaaagtgaccaactgactgtcaatccttaatattctttagttttttcgattattagtgcgttgctgccataatgcagctaataatcactttcattcatagactcccccaagtctgatgaatggggttcatcaaagcccccactttgatgtttcctactccttgaccactacatccgctgatgtggtggcttttttattgccgtctaaaaaagccgtcatgggtatgcaatccccacaacggcctgctattatcttgtaatagccaaaacaagcggttcaacaactgcctgtttcgattagatccaactggtacccaatctactcacgagtaaattatgtgccaccaagatttaatcttcttccaactcaacattgctgttcgttcgacgagcaatgaaccattccttgacttgaattaaaacccacgcgattcccgctgtaaaaagcaacaacattagtgtcgaaacaataatgacgatcacaatctgaacgccttctgcctttaacacgtctaacttagttactaacgcgatccctgatggaatgaaaatcaagctgataaattggacgaaaaagttgctaacacccgccacctgctcaagtttgaccactttaaacgttaacagcaagtatagtagaatcatcccaatcaacggtgtcggcattgggaatgcgggccaaatcttattgactaaattagcaattaaactactagccaataaaatcaaaccataaatcacaatttgtgtaataaacgcgccttttttcatcgaatccctcccggaccatctaacctaaaccaatcaactgcgcaaaccctggaaccataaaattaacaagaataccggcaatcacaaaggcgattgcaccagttgcgcccgcagcctcgctcacttcaatcgctttagtggcaccaaccgcattaccggcaattccgaatcctaacccggcaccgagcggattcttgtgcaatttgaaccagcgaataaaatggtcgcctaacgcgtaaatcaaaactgaattcagaatgactgcgaacgccgcaatggcttgatcgccacccaccgactcagccaccggtaaagcaattgctgtcgttgctgcttgtactaacatggcacctaacgctgcatccgtcagaccgagcaaccgtgaaatcccatagataccaaataatgacagccctaacccaatcgctaacgcaatcacaatgacatcccaatgtttcttaaagatatcattacgcttatatagtggcaccgcaaacgagacggtggcgggcgccacaaaccagaataaccagtcgccaccaacctggtacgcttcataaactttttgcacgggtgcctttagaatcgacgcaatcaataccaataaaccaatcccgagcagcattccaaaaaataacggttggaataacacaaagcgatttgttttgtgatataaatactcgccaatcccatacaccaagatcgacagtccgatcccgaaaaacggattattgagaagatagctcacataagttcctactttcttttagtgaaaagagtgacaaaaaaggtgccccatccgggtctagtcatcattaaatggtggttaggctcagaacagtgcaccaacacggttctcatttatcattaattaattataacacatcaaagtaatttttaatagtaggttagttcgtcaaatttaatcaactgtataaaacatcaatgcgtaagcgccaacaccggtgtgcgtcgcaataattggactagtacgcgcaaccagtggcgttacttgtggaacgacttgttggagaagcttttctggcgcttccgcaacgctcggttcgccgacgtaagaaattccagccgcttcgactcgagtcgcatccgctaattggtctagaatttgttcctgcgctttgattagcgcctttttcccgcgcccccgcgtataaaattttaattttccggcttctaattcaaagacaaattttaatttaatcaaattcgtgaccatgccagccaacttagggacgcgcccacctttgaccaaattgtcgagcgtatccacgaacaagtaggtcttagtatgctgccgaatgacggttatcttcgccaaaattgtggccatatccgcaccggcgtgagccatccgtgctgctgtaagcacttgaaaggccatcccacggtcagccgcctgggtatcaataactgtcacatcgccactagcaagtttggcagcttggcgagcagcattgaccgtcccactcaatgtctccgtcaaatgtagtgataatacttggctaccatccgctgtcaattcatcgtagcaactgacgaaatcaccaattggcggctggctagtcgttggcaagactgggctgactgccatctgttggtcaaattccgcggtactaactgccgtatctgcaatcaagtcgccaccgaaccccacgagtaacggaaccactttaatattatactgtgcaatctcggccgtcgttaattggaccgacgaatcggtgacgattttaattgtcatatttggaaaacacctttcgattaatttgtgcttcattatagcacctcagagtctaggaccaataaaaactgcgtcacaccagcatttagccactcatattgatttatgacggtcatcatttcgttataaactttgtaaaaatcgtcatattttttcgttccatgacctaactttttcgtctgaaaatcatgcttttaaacttttcgcgtcacactttcttcacgcgtcgccgctatactatgtttatagtcattaaggaaatcccaatccttaacgaccccctaactttaatgattacttccccaagtaatgatgtgtgtgtacttaattacattttaccgatttacttcccttttcctccgtatttccccgatacggaggttttttattgccttcaagcagttgtggctcacgcgtgaacaccgtattaaccataatcattgccaatccaatttccaccataaaaaacgcgccaaggcgagaaacaaacttctcaaccttaccgcgtatcgtggccctaatacttatttcatcttatcgagatcttctggtgcaataaaaaaactgacctgtcccgtttctaaatcaacatgcgccttcacttcaacacctttaggaaaaatccagcctttcccagtatctaactttaacggcatttccccatacgttttggttcgatacgtcttttccatcagaaaactccttcgctctttgccaattacgattaactgggctaattatataatctgacgtcgtttctcgatagtaaagacactttccaatggctttcttcagtaggaatgtcacgctaaatctgatagaatcggattaacattaaaccacttaggaggggtcgaccttgttctattcgttttttgatccgacttacctattagtcatcattggactgattatctcaatggccgcatcgggttacgttaatcggacattccggcattatgatgcctatcgtagtcaatctggcacaaccggcaccgatgcagctcgctttattttaagccaatctggtatcaatgatgttggtgtccaaaagataagcggggatctgaccgacaattacaacggtcaaactaagattctcagcctatcagaagccacagcagattcaacctctgtggccgccatcggagttgcggcccacgaatgcggacacgcagttcaagatcacgttaactattggccaatgcgcttgcggaccgccctcgtgcccatcacgaacatcggttcaagcttatcattaccactaatcattatcggcgttttattgagttacaaccaaacactgattcacattgggattttactcttctcactggcgttattgttccaacttgtcacgcttccagttgaattcaacgcctcaagacgcgccctccagattttatctgatgggcaagttttgactcgcgacgaagttcccatggtgcgtaaagtgcttgtcgcggcggctttaacctatgttgctgcagccctgtcaacattcttacaattactacgactaattattctattcggtggtaatcgtgacgataactaatcgcgccaaatggcagtgcccacagccagtcaccaaaatctgcttggtcactatcaacttagcgtcgccgcaaacttgttattactagcattgattgcgaatcaaaatagtcacttcaaaggacaacttttgaagtgactattttctttggccccaaacagtcgatcatcgcacctcgccaaggcattccgtaagaacgttgatgattcttcacacttcttaataaagcctttccctttttttcatgacattcgccatgttcagtcacaaattcttcacacaacctcggtatgattacatcatagcaattgaggttaactcaatcagctataacacaacctaaaatttttcatttactcctccaaagtaatgaaattcatagtaacatgtgattccccgtcacatgtttaccctactcctttttccaccgtattccccgatacggtggtttttttgtttttctcgtccgctctattcgcacctaccgactactttaatacgtcatagtaatcatatttgttgtactttttacattattaaaccaaaatataactaatgattaaccatgctttttagttattcatctgttaagggggagatttactgatgaagcaagtatcgattattggcgctggtattggtggcttaaccgctgcagtacggcttcaaaaattaggttataatgttacgatttatgagcaaaacgcgcaaccgggtggcaaaatgaaccagattgttagccaaggatttacatttgacgtggggccgacgatcgtcatgatgaaagacatctacgaagaagtctttcgcttttgcggggtcgatccgcacaactatttaccattcgaagaagttcaacctttgatgcaccttgtctttggtgatcaatctagtctagatttgtcacgcgatctcccaacattaattgccgagattaaccgcattgcgcctgatgacgtcaatggtatgttaaattttttagcggatatttatcaccggtataccatcgcgaagcctaattttttagaacgatcatttcgtaactggcgtgacttttataacctacccgctctgtatgcaggactacagttacgcacctttaacaatgcctacaaaaacattgcaaaatttatcaagaatgaaaatctacgtaattcattagcctttcagacactgtatattgggatttctccctaccagggcccgtcgctatacaacattattccgatgattgagctcttctacggggtctattttttaaagggtggtatgtacacagttgtcaatagtctcgttaagttattcaaagaacagggtggtacgttaaagcttgccacaccagttcaagaaattatcatcaaagataaagttgctgttggcattcgtgtcaataatcatccgatccacagtgactatgtcctatgtaatgctgattttccaaccgccatgacgacactgattccaaatgagcaaaatcgtggtcagtacacagatcaaaaaattgccaaaatggattattcatgctcatgtctcgtcttgtatttaggactagacaaaaaatacccaaccgaagcattacacacgatccactttgcacaagatttcagcaaaaacgtcgccgatctatttgacaacggcaagttaccagaagatccctcgtattatgtctatgttccatcaaagatggatccaagtttagctcccgaaaacagtgaggcactctatgttttagtaccagttcctgagctctcaaagtttaatgactggtcaccaacaacactgaagaactatcgtcaactaatcattaacaaactaagacaaacggctaccttcagcgatattgaacagcatatcgttgtcgaaaagtagtttacaccggttgacttcaaagaacagtttggcgcctataacggagccactttcggcttacgaccgacgttaaaacaaagtaattattatcgtccccataacaagttcgactatgccgaccatctttatttttgtggtagtagcacccaccctggggccggtgttcccattgttatgcaaagtgctaaattagccgttgaggagttgattaaagatgaccaaactaatgcctaaattcgaacaacatcgcactgactttgcgtactgtcaaacaattactaaaaggtcttctagcgcattctacaccgccttctcgcaattaccactagaacgcgcttggagtatttacgccgtttatgctttttgtcgaacagccgacgacctcgttgatgttgaccatgatattgatggtctaatggcattgcgccaatcattgaccacctttgccaatggtcatgtcccagaccacccaatgtggcgcgcactggccgtcgtttttgagacttatgatatgaatcttgacgtctttttcgatatgctcactggtcaagaacaagacgcgacttttaaacaacctcaaactcagcaagcacttgaagactattgctattacgtcgccggatcggttggtctgatgattttgccaatgctagcaactaacccgcaatcacttgtcaaaccagccgtagaattaggcatcgccatgcaactcaccaatattttaagagatgttggtgaagactaccaacgtggccgaatctacctgccatcaaaactattggcacactatcagctcaatccaactgacttgcatggccccatcccatctgccaattttattcggctttgggaacatgaagcacagattgccatgaacaagtacgaggctgcattaaccatgatgccacaaattgatcccgtcgcccggccatcgctattagccgccactttgctttatcgtgaattattgctaatcgcacgtgaacaacattacccaattttaagtcagcgcgtctttttgacagatgaacgtaaaacacaggtccttaatcaagttagcactaaagtgcatgaactagcccttaaggaggcttaatgcggcttgaatcggtatcatacttggcacgacgaaatctgtccataccggaatattgaccacccacaaataatttttagttttttcaccagtcaagtaagcgatttagttaccttttaacaatcaaactactatactaaacatatagtgactggacatctccttcagccacttgaacctttttcatttactcctccaaagttaatgaaaaacaggctcgctggggatgccacctagcgaccaatgcaatttataggtcatcgcccgccgcgatggccttttatattactagaataatatagttacatctcacttctaatcggcgtatcatattattgagagattagaggagtgatatttaatgaaaaaaacacgcgccgtagccggaattagtgctcctgtggcaattttttcggccgccctattcgcgagtgagaagctctacgattttgctttcaagcgtgttgattacgtgcccgaaacttcggcagataaacaaaaatacgccgatgcctactacgcttatgtcgattggctacaccgacagcccgttcaacagtggcaactgaacgctaatgacgaggccaatcaccttgtcgcacagtacgttcctgctaaaacaaccagcaaccgaaccgttattgtttcccatggctacaaaggtgatggtgaaacgatggcaaattacgcttatatgttccatcaaatgggctacaacgtcctcttgcccgacgatcgcggccatgggcaaagtgccggcaagtacattagctttgggtggcaggatcgccgcgactatttaggctggatcgataaagtcgtccgtatcaatggtcgtcacacggatatcatcctttttggtgtcagcatgggtggtgcgaccgttgaaatgatgagcggcgaagaccttccatcacaagttaaggccatcattgccgattgtggttattcgagtatcgaggaagaactcgcttacttattaaagcgacagtttcacttaccaaagtatccgtttgtgcccatcgttagttttattaaccgccaccgtatgggctattatttaagcgacgtcagttctgtcgaacagctcaaacataaccatctaccgatcttctttattcacggtgacaaggatgtctacgtcccaagttggatgctcaaagaaaattatcaggccgctaagggccccaagcagatgtggcaggttcccaacgccactcacgccgagagtttttggatcgatcctgccgagtatcaacgacatgttacagcctttttgaatcactatgttcctgataaataaaattcagtcgaaaaaccgtatgcgctattcactgcacatacggtttttttgaccgcttaagttgttttatgactggctaatgattcgggctaagcggtccgccatctgttccagattggctggtccctgcgccatggcttgatctaaggtcatgacttgatcgacaatcggtaaaacagccgtgaccccctgtttggcaaatgtttcatttgcacctttttgccgaccaactaataaatagcaaggcttgccggccgcttgggctaactgactgagctgaattggtaccttgcccataaaactctgatcgtcgacttggccttcaccagagataactagatccgcttgggccactttcgttttaagattgctcatttcagctaacaattgaaaaccagagcgaacgcgggcgtgtaaaaagtaacgtaatgcaaacccaataccaccggcagccccatcgccttcgtgggcactcaccgcaccagctgcgaccgtcatatagtgagctaaagcggcatcgtgaacctgaatttgagcaaccggtaatcctttttgtgggccaaaaatcttagctgcgccgttcggtcccgttagcggattcgtcacatccgctgcactaatgaacgagacttcagctaattgtggcaacacatgtcgatcgtcaatcttagtgacccgacttaaatcagcgccagtcatggctaactcttgaccatcggcagcccaaaaacgataaccgagcgcacgtaggattccggcaccaccgtcgatcgttccgctaccgcctaagcccagaataatctgccgggcgccacgctcaatcgcatctttaatcagtagcccggtcccataggtattcgttgctaacggcgtcaaggtcgtcgtgacaaactggattccggatgcagccgcaacctcaatcactgccattttttcagtggcaaagtagccatacgttgcagtcactggccgttgcgccagatccaccgttgatgccgtaatagcttgtccaccagcatggttagccagccacgccgccaccgttccttcaccaccatcggcaatcgcaacttgagtagcggtgattccgtgagccgcaaatcgtttagccactattcggttggcctgaatgctcgtgatggaatttttaaatgaatcaattgcgatcaaagcgtgcatattaacgtctccctattgacataattacttttagtataatcattacagcgggcgcgagcaattcatatcagttgtcaggtttcttaaaactcgttaagcttaagttaccaaaattttaatggaggctgataaatcatgacaaacaaatacgattacgatgtgttatacattggtgcgggtcacgccacgtttgatggcgccgcaccactcgccaagactggtgttcgcgtcggtgtgattgagagtggtctgattgggggcacctgccctaatcgtggttgtaacgccaaaatcactcttgatgaacctgtcaaattaacgcgggaagcagcacgcctcaatgatattttgagcagtgcaccaaccattaattggacggccaacgtggcccataaacaagagattattgatcccttaccagcaggcctgacagctcgtttggaagatggtggtgcaacgatcattcatggtcatgccacgttcaaggacgctcacaccgttgtcgttgatgatcagcaaaccattaccgctgaaaaaatcgttattgcgactggtttaaagccccatcgtttagatattccggggaccaagctcgcccacgatagtagtgattttatgaaccttaaacggttaccacaaagtatcgtcatcattggcgcaggctacattggtatggaatttgccaccatcgctaacgcagccggtgcccaagtgacagtcatgttacatggtgaccaggccctccgtgatttttaccaaccattcgttgcacaagtggttgacgacttaaccgaacgtggggtaaccttcatcaaaaatgccaacgtgcaagcatttaccaaacaggatgaccagttccaagttagttatggcgaccaccagcaattaacgaccgactggatcctagatgcgactggtcgaattccaaacttagatggcttaggcttagaccggattggcgtcaaatatgaccgccacggcgtttatgtcaacgaccacttacaaaccaacgttcctaacatctatgcagccggtgatgtccttgccaatgacttgccaaaggtcacacctgcagcctactttgagtccaaatacttgatgcgtttgttctctggtcaaaccagtgctcccattgactatccggtaattccatcggtcgtctttacttcaccacgaattgcgcaagctggcatgaaaataccggccgctgaaaaagccggcttaaccgttagtgataatgatttagcagattactggtattatcaagtctccaaggaaccgattgccgctagtaaacaggtccatgaccaagacggccatctcgttggcgtgactgaaatcagtgatcaagctgaagatgccgtcaacgcactactgccagctatcgaatatcaattagaccgtgaacaaatcgaccgtttgatcggtattttcccaaccatcggctacgcagcttggcaccgggcttaaaacagaaaacactgctgcgaccgccgcttgattaatcccttattaataaccagagccgccaatgaccccccactcattggcggctctggttatgttcgttccattactttagaaaccaactcgggcctgcacatcaagcatactgacctataattgcgcctatctcaacgattgaaaggttggtcctaacaatggatgtggatgctcaaaaattatttaccttagtagatgctgcttataatcagccgattaccaatcaaccatccgattcctaccgccaagcgctactggcagctgcaatcgacctgaataacaacgtttcgccacagcaagtaaccatccagctatatcaagcctattatcgtaactatatggtcccaatgactctaccacgccagcatcgtgacctctaccaatacgttcacacccaattacagcgcctcacgcgcaaagaacagcgtcatatggcacttgggtatggtctgattgcgacgcacctaacatttggtcccttgaactgaaatcaaggtacttacacgcattgcgctagttatcgtttagtatgaagcatgattaaaccgtgccattatcaagctcaaaaatagccagtaatcgtccccagcctcggaggtcgaaataggacgcgcatcggctgacgaataaacagcccatctttttaacacgttttaatcataataaaagcctcagcgattaccatcgctggggcttcatcgtttttaaattaatcgtctaatcccaatcgtttgaaaatgtcatcaacgtggcgaagatggtaatgatagtcaaacgcatcatcaatcgcagcctggtccaaatgttcacgaatctcggcgttaccttcaacaagtggcttgaattgtaactgttcatcccatgacttagccgtcagtggttgaacgaggtcataagcactttcacgagacatccccgtatcaatcaacttgagcaagacacgttgactgtagatcaacccgtaagtcgcatccatgttttgcttcatccgttctgggaacaccgtcagcgtcttaataatcttattgattcgagttaagatataatccactaaaatcgtggtatctggtaagatgatccgctccgcagaagagtgggaaatatcccgttcatgccacaacggcacatcttcataggcggtcatcatgtggccgcgaataacccgtgccaaccccgtcacgttctcagaaccgatgggattacgcttgtgaggcattgctgatgagcctttctgacctttattaaagaattcttcaacttcatgagtttcagatttttgcaaaccacgaatttcggttgcaaacacttcaacgcttgttgcaatcaaggccaaactagcaatgtattcggcatgtaagtcccgtggtaaaacttgcgtcgaaatttcttgtgcgcgcaatccaagttgtttgcagacaaattcttcaacaaatggtggaatgttcgcaaaagtcccaacggccccactgattttacccgcttcaacgcctgcggccgcgtgttcaaaacgctcgatatcccgattaatttcagaataccaccgggcaatcttcaatccaaatgtggttggttcagcgtggacgccgtgtgtccgccccatttcaaccgtatatttatattttttcgcttgttgtgctagtgtcgcccgtaaatcttgtaagtcttggcgaataatcgcgttagcctgcttcaaccggtaaccttgcgccgtgtcaacaacgtcagtactggtcagcccatagtgaacccacttacgttctgcacccaacgactcggaaacatcgcgcgtaaaagcaaccacatcatgatgcgttacggcttcaatctccgcgatccggtcaacatcaaacttggcattctctcgaattttagcaacatcacttgctggaatcttccctaattcagcccaggcctcgtcggcagcaatctctacctccaaccatgcttggtactgattttctaacgaccatactttgcccatcgcgggacgcgtataacgatcaatcattgctaatcctcatttctttttaggtattcactaacaaaacacgaacattattatagcatacccctcgagtaattaatagagacgaacaatgaaaaaatactgttatttttcactttgtttccatattaaggacttgttttcgaactaattcgtcttaattatgaacgattatttgcgctcaaaacaagaacattcggtttttgggttgcgttttgacgttaaagttgctatactctttcctgttggagtggtgaacgtttaactactctttaggattaattattcataattaaactatttaatgaggtggaagaatatggcatcagtcgtagtagtaggtagccagtggggcgatgaaggtaaaggaaagatcacggactttttgagtcaggaagcagatgtggtatcacgttaccaaggcggcgataacgccggccacaccatcgtatttaatgggcaaactttcaaattacggctgattccatcagggattttcttccatgataagttagctgtcattgggaacggcgtggtcttaaatcccaagtcattagttgaagaattacaatacttgcgggacaagggcgttaatcctgacaaccttagaatctctaaccgtgcacacgtcatcttgccttaccacatcacattagatggcgctcaagaaaaagctaaagccggtggcaagattgggacgactaataagggaatcggcccagcctacatggataaggctgaacgaattgggattcgcgtagccgacctgcttgataaggacacctttgcggcgttactcaagcgcaacttagctgaaaagaaccaaattattaccaagctttatgacttagaaccactgaaatttgaagatatttttgatgactattacgcttatggtcaaactttgaaaccattcgtcaccgatacttccgttgtcattaatgatgcgttagataacggtcaacgcgtcctatttgaaggtgctcagggagtcatgctggatattgatcaagggacttacccttacgttacttcatctaacccagttgccggtggtgttactattgggagcggtgttggcccatctaagatcgataactgtgttggggtcttaaaagcctacacttcccgcgtcggtgacggcccattcccaactgaactctttgacgaagtcggtgatttcattcgtgaaacggcccatgaatatgggaccgttactaaacgtcctcggcggattggttggttcgatagcgttgtattacggcatgctaaacgagtttctgggtttactcatcttagtttgaactgcttagacgtcttgacgggcttaaagaccatcaaggtatgtaccgcttacgacttaaacggcgaaaccatctatcactaccctgctagtctgaaggaattagaagcttgcaaacctatctatgaagaagttcctggctgggacgaagacattactggcgttaaaacctttgaggaactaccaactaatgcacagaactacttgcgtaaattagaagaactcgtcggcgttaaaattgccaccttctctgttggtcccgatcgcgaacaaactaacgttatcgatcacaacatttggggctaattgaacgcgacaccgtgaattaacttaaaggagttttgcatcatgggcatggagatttttgattacgaagatattcaactaattccgaacaagtgtgtcattaatagtcgttcggaagccgatacgaccgtagaattgggtggccgtcgttttaagattccagtggtgcctgccaatatggcaaccgtcatcaacgacgagatttccaagtggctcgccactaacgactacttctacattatgcatcgcttcgcccccgagacccgccgtggttttattgaaacgatgcatgccgcgcaattgtacgcatctatttcggtcggtgttaagtccagcgagtatgactttatcgacgacctggctgctaatcaaatcgtgccagaatatatcacgattgatatcgcacatggtcatgctgacagtgtcattgcaatgatcaaacacatcaaagacgtccttccggatagttttgtaattgccggaaatgtggccacaccagccgccgttcgcgaccttgaaaatgctggtgccgatgcaactaaggttggcgttggcccgggtaaggcctgcattactaaagtcaaaacgggctttggtactggcggctggcaattagctgctgtccggtggtgtgctaaggccgctcgcaaaccaatcatcgcagacggtggtgtccggaccaatggtgacatcgccaagtcgattcggttcggcgctacgatggtcatgattggctcaatgttggccggacaccaagaatcacccggcaacattttaaaaatcgatggtaagacttataagcaatactacggttccgccagtgaaactcaaaaaggcgaacataaaaacgttgagggtaaacaaatgctggttccttaccggggccgcttagtcgacaccttaaacgagatgcaagaagacttacagtcatccatctcatatgccggtggccgggatttaaaggccattactaagtgcgactatgtggtagttaaaaattcgatttacaacggggactaattaagactcactaatacctaaaaagcttgtcagccatttctggtctgacaagcttttttagtatccaattctaatttttacactcactttaccctgacagcggctatgaaagcggttataataaagctaaatcactaatcgaggtaatcagactatggaacacaatcgggtcttacgactagaacacggtattaacttccgcgaactgggggggtatgagaacaccgctggtcagacaatcaagtggcaaaagctgctgcgttgcggtggcatgtcactactcactaaccgcgatctcacctacttggataactacggactccgttatgatatcgatctgcgccaagccaatgaagctgagatgtctccagaccgttatcccaagaatactaagtatattaatacgtctgtctatccgttcactgacaatcgtcgctttgatcgccgtttaaaacggctcatcaagcgaatggtcgtcgatgattccttcaacgcacaaacatacgcgcaaatgattacagatagtcatgccgtgaaagtctggcaaaatttatttgcgaccctcctcgccaacgaccagcccgaccaatcggtactctttcactgtgctgctggtaaagaccgaacgggggtcgcgggtgcgctcattatgacggccctagacgtcccccgtgaaacgattatgcaggactacctgctcactaacgccgtcttcatggccgcagacagtatggataccgctacgattattaccaaggccaatgctggtgacctagctagccaattcaacgttgccatggctgttgaagccgacaatatgaagatggtctttcgggttttcgacgacctctacggcaatggtattggttatttacgagaagtgcttgggttatccgtagcggatattaataatttgcgccaattgtacttgaacgactaaggaacactaaaaaaactggttttgaaagtcaataactttccaaaatcagtttttttgcatcatctattcaattgtttaattataaaattggtgataacaaccgtgaaaatgtctgcttgaacttcaaccagaatgattgatttttaaagtcttgaacggtaatcaaactactgattttttgatcttctaagaaaatccgttccaattcttgtgctaaatcagcatcatataaaaaggcgttcacttcaaagttgagcttaaagctccggaagtccatattagctgagcccactgacgccacctgaccatcaatcacgatggtcttggcatgaataaaaccattattataataatagatttttacaccagcatctgccagctcccgggcatagtactgagttgcccggtaaacaaaggcatgatcaggtttgtccggcaccataatgcggacgtcaacccctgacatcgcagcgattttaatcgcatctaatacggaatcgtccggaattaggtatggcgactgaatccataaacggtgttgagctgtcataatcattttaatataacccaatttaatctgttgtgcatcactgtccgggccactggagacgatctgtaatgaagtattccctttaacgcgaatgactgggaacatattaacgtctggcacgattcgatgttccgcatcggtggcgttccaatcacgaatgaaacgttcctgcaattcaaaaactcctgaaccgacgatccgcaaatgggtatcacgccagtaaccaaacttcttactacgaccaaggtactggtcaccaacgttaaaaccaccgacgtagccgacccggccatccgttaccacgatcttacggtgatcacggaagttgagacggaagtccaaaatcgctgaatgagcacccaagaacggtcgggcatgcccaccaagttcttctaaatgcttaaagaagctgcggaacgtgcccatcgacccccacggatcgtacaagacacgaacgtcgacgccttgggctgctttccgctctaaaaggtgtaataattcatttccaatctggtcattataaaatgtgtaatattcaatatgaatatgattcttagctgcttcaatatcttggaacatcgcatggaacttctcatgtccatccgtataaatcttgacccggtttttacggcttagtaacgcgccatcggaattcaagaataaactgaccatcccacgaaccgagctagtgaccgcatctgcgggcatcaattccgttcccagggcttcacgttgccgctgaatcatctgttcgagtctaatttgcgtctctttacgtaaccggaataaccggtttttcggtaacttacgaccgacaaaggcgtacgcgataaacccaataatcggcaaccaaatcaacacgagtagccaagcccaagtggccgcgatgtcccgattacgatcccggaacacggtaacgaacgccgcggccgcgtttaaaacgataattgtatagaaaattggctgaatatattgcaatggaggcacccacctaatttattaatgatggttttattttaccgcagatagtagtgagataataatcttttgcgaatataatttttgcatttaatcattaaatagctaataattatgcttaaggagggcgcgttcaatgcttgcaatgcttggaattcacggcctcggccccattcgcatgtttcacttaaccgaacacattgcgggtccgcgagcggccgttggtattttactaattattattttattagcggtcgtctaccgttactatcgacgacatcgttaataaatcaaatctttgaagcagctggtgaagtctcccagctgtttttttgtgggtcattatcttacggatcggtttattcaatcattgcagtatacctctgctaccaccggagaaactcataacaaatatttttgaccaagttaaatcctcaaataaaaaagttgcgttgattagacaatcaacacaactcgattcgaccaccccttctgaacatctgttgtatggcctgattgagttaacgcattacctaccccatttttcaatgtaggccgatagtaagctaaatcattggagccacctggttaagggccttttatgaaatcgttagttcacgcaaagacttgtcgcttaaagcttggacgtaattcgaacgtcccgttgcgctgagtttttgattggtatcgagatagatttcacccgtccaatgctttattcttttagtcggcggtctgacgattacgcgatagacgatggggcaatttttcagggtcatattttttgatgactgatgcaaaaactttttgtatttcttactttccgctaatgtttggctggttgcaaatgtgtattcataccaaataatgccgctaaaagggccggattcttccttgattattgtgtttctcaagacacgcacgtcataaggactgctttttaacattgttgttagtacagtcctcgcttgatttaactcaatacgatttttaacgtacccgtataaacagaagctactaataaggataattgcaaaaagcacgtaatgtgtaacggtctttgctttaagaaatgacgacatgactaatgcctcccaactttattatctggaaatagtctggcaatgctttatacattatgaatgcagacgtactagtatcaatacttttattaccaacaccaaaccaatcagcttgctatccccttttttgattcaagatctgccagtcattgcaatcactagcttcgataccagcaacaatcagcagacccagtagtccactaatttcaagtggcctttaatattggtcaggacttgatttgcgttctccttttgaatatagcaaacgccaaacccattgtcaccaactaataaacatcattcgtatttgttaatttcaaaattgcaatcaagattgtatttggaataataaaacttatgcaaatgtggtcaataaatgttgatattggaaggccgggacgaattacatcagtctctcgtaggctgttttacctgcaagaaaattaattatcaaatttgattcatcaaaatactttaaggataatcataatcccattttattcatataatcgatatcaataaaaaagggttccaataagccgctcactctctccagttcttcaggttgcatcaatcaagtggcgattgagtgagccaaaaccatatttcctaaggtccttcaataatccccactcacaatcgcaatcacaaggtaagttaaccttcagaaaaacaatccccgctatgttcgctatatcaccctattaataggcgttgaataccatagctaattaatcacgattagtcagacaatcagcaagaagtcgcaggatgtcgcgcgattgcgtccaattatttggcttttagtcactatagcccatcagaatatttattttggtcggattgaccatcgtaactttgtcaaaaccgattaaactaaagctatcacatcgaaatggggcgatgattatggatttatcacacacgcggttactccgcaaaaaagatatcaatgccatgttagccacttatcacagtccgctcaaaaaggaacttaaaacatttgacctaacgatgctgggaattggggccatcatcgggaccgggatcttcgttttaactggtacgggggccttgacggcgggtcccggcctaatgatctcattcgtcttggctgcgattgcttgcctgtttgcttcactctgctatgctgaattcgctgcgatggtgcctgaaagtgggtcagcgtacacctatgcctacacaaccctcggcgaaattgttgcattcattatcggctgggacttgatgttggaataccttttcgctgtctcaaccgtttcagcgggctggtcaggctactttcaatcattcttggcaggcttcggcctcaaactgcccgctgctttgtcggcagctgcaggttccgttcctggtgtgaccagctattttaatctgccggccttcaccattattatcctgattaccactttattgtctctcggggtcaaagaaactaaacgcgtcaataacgtcatggtagtgattaaattagccgttgttcttttattcatctttaccgcggtgcgcttcatcaagccggcaaactggagtccgttattaccgtttggcttcaaaggcgtattcggcgcagcctctagcgttttcttcgccttcatcggttttgacgccatttcatctagcgttgaagaaacattggaaccatccaaaacactcccacgttccatgttactgtctcttggtatctgtaccattctctacgtggctgtatcagccatcatgactggcgtggtcccatttgaaacgtttgccaagtacattgatcatccgatctcggccgttcttatttactccggtcaaaattggatggccggaatcattgaccttggcgcgattcttggtatgaccactgtaatgttagtctgtctctacggtcaaactcggatttccttctccatgtcgcgggatggattactcccccatgtctttagcgatattagcgccaagaccggtgcaccacttaaatcaaccgtcttgtttgggtcgattgccgcaatcatgggtggctttattccattagctgacttagctgaactggtgaatatcggtactttgactgcctttaccctagtttccttctccatcttacggttacgtaaaacacaaccagatcttcggcgtcccttcaaaacgccatgggtcccgtttgtaccaatcatgtcaatcatctgttgtgtcttcctactaatcaacctgaagcctgtcacttggattcgcttcgtggtatggttagccatcggtatggtcgtttactttggctattccgttaaacactcccagttgaagacgaatacagccactgatgagaaataattgactagactaataaattcaaaactaatgggtcgcttcatttcagcgttatcaactggaatgaaacggcccattttttatcctctaaatacgaacaaccgggttacttattgtactcaacttgaagtaaagttcacctaacaaaacgtaagttgaaacttgttaacatgagcaaatttttagtttgtctggttaaccccttttgaaaaaagctagtatagtatgagtcacagttctaattgaagtgggggtcaataattcatgcgtaagcaacggattcaggaacgttcattgattggcatgttaatcacattaggcgtcgtgtacggggacatcggaacgtcaccgctatacgttatgaacgccctgatcaatgacgcggggcaacttaagaatgcaacacctgattatgttatcggcagtgtttcattaatcttttggacgttgatgctcattacaacggtaaagtacgtcctgattgctttacgcgctgataatcatcatgaaggtggcattttcgccctgtatgcactggttcgtcaccgggccaaatggttaattttcgtcgcgttgattggtggcgccgctttgttagcagatggcaccctaacacctgctgtgacagtcacatcagcagttgaaggcttaaagggattacccaaactgggggctttttcccagtacccgtggctcgtgcctctaaccgttacggttattttactggttctctttatgattcaagggtttggtactgccgtcgttggccggtcattcggtcccatgatgttgctctggttcaccgtcatcggcatcttcggtctgatcaacatcagtcaggcacccgtcattctcaaagctttctcacccgtttacgccgtacaagtcttattcaatccggctaataaaatgggaattttcattcttggtagtgtcttccttgcaacgaccggggctgaagcgctgtattctgatatgggtcacgttggtaaagccaacatcgacgccacttggccgttcgtatacacgactttgattctcaattatcttggtcagggcgcgtggatgttaacccattatcaggatgcggcatggcgcaatgccaccaatgtcaatcccttctatgccatggttcctgcgggcggtcaaattgcaatgattatcttagccacggccgcagccatcattgcgtcacaggccttgatcacgggctcttataccttagttgacgaagcagtcggtttaaagttcttaccacgtatgattatcaagcaccccagtaacgttcggagccagatttatattggtgcgatcaactggctgttatgtctggtcaccttaggaatcgtttggctatttcaaacttcagctcacatggaagcggcgtatggtttagccatcaccttaacaatgttgatgacgaccatcctgcttagccagtggattcacatgaagggccaccgggcgctggcgctagctttattattcggctttggcgcactggagaccgtctttctaacggctagtctgaccaaatttattcacggtggctatttaaccttggggctgaccctcgtcattttcttgattatggtcgtttggttctttggtaatcgccggcgtttgcgttacaaccaggcaaatgaacagattagtctgctagattatcgtaatcaactgatccagctaagccacgatgatcacctgccagtatttgcaacgaatttagtctacttggctaaggtcgaccatcaacaccgggttaaacggtcaattctgtactcgattttagataagcggcctaaacgcgctaaggtttactggtttattaccattaatgaaaccaaccgaccttatgattgtagttacagcattgacatgctaggcactcgaaatatcgtggaagttcaactcaacttaggtttccgtaaatcacagcacattaatttatatttgcgccaaattgtcacgaacttaattgcagatcacagcatcgatccccaatattcccgttacggaatcacacaacctcgtcaagttggcgattttaaatttgtcgttcagaatcagcagatcatggaccttgctagcaacccaactatgggccagttcgatcgactactaattggtggtcgcgttctactacaaaacatcaccccatctcctgctatctggtacggcttagcgtttagcgatgtcttggaagagacgattcctttgttcacgaaaccagcaacggacgccacactaacgaatttgacggtccaccatgcccgcacgccgcaacggaattcgcgccaaccataaataaaagactagtttcaaggaattcaaccttgaaactagtcttttattattaaaatctatcagtcaacacacttatgtttgcggcataaacattaccttagtgtcaataatgccatactgatttcgcatcacttgctcgattctttcactgagctgaaagctggctgccactgtcattcgtggtgacactgctataaccagcgacaaggccactaagctcccagaatactggacatcaattgcattgacctgattcacaccatcaatttgttgaatcgtattaatataatttttttcaacttgtggatcactgtaattaattagctgcaacccactgtcccgaaaaatttgtaacccagcggcaaaaataaagaatccaatcacgatactcgcaacactatctaaccaagcaaatttgaatagtaagaccccacttaatgagattaaagtgccaatgctcgttaacgcatcactaagactatcctttgccgcagccaatagcgtcgaattatctaattgttgcccaccgcgacgattaaagtaccagacgactaacataacgatgctcgcgattgcagctccccaaacagttacaccgctcactgcttgaacggtgtgtgatttaaacaaattactaacaccactcacaataacttgtaccgccataactaacataatgaccccactcattaacgtgaataagtcttgtaaacgaaatcgcatcaatcgattgcgacgttcggcctcccagccgtccaaagcggtcactttactttgatgtgattgatgattatgaatgccaccccagataccaagcgataacaaccccgatgaaacaatacccgcaaaattattaaacgcatccgcgtgcaaagattgcgaatgaccaatcgttgcaagcactagttcgattacaaatagacttaaatatgctatcgcattgcccaacaaatgccacaacgcaccttgcattcgcttaatttggtcagcttcaatttcttgccagccatctaacacgggatgttgattatttgattgattaatcgtaatcgccccctcctaaacagattccaaccgctcactctaacacttagtcgcaataagtcaaccttataccacctagaacgctgatagcttaacactaacagtctgacttgtaattgtcactatcagcatctttaagcagtaattaattaaagctggcaccttcgaaagtaatccacttcgaagataccagcttacaattgtctttgataacctttacgcgcagtcacaagctactgttcatataaatcacccgaccccatacaaagcctgctaccggtaaagtacagttacaatcacactaaggttcacgtttcgctatttgagacgtcacgcgtcgcggctcagaattctgcacacccaaaatgtctaggaagaatgaaacaattggaatcccaatgatcaagccccaggcccctaatagactttccataataatcaacgtaataaaagtgacaaagactggtaaatcagtccgatccgccattagccgtggatgaaggaaataagactcgaaggcgtgaatcaaaataaccaacacgatgatccagacaactcgaatcaagccacccgacgcaaaccccagtaaggttagcggaatcattgaaatcaacacgccagccaccggcactaagcctaagataaagacaatgatcgacaacaccatgatacttggcatcccaataatcatgaacccaatcgtcatcaaaatcgtattgatcgtacaaatcaccagttgcgtttcaataatccgccccagaatcataacgaatttatgcgttaaatagtaaacgttcgtgaagaactttttaaacttcgactgcaagaactggcggccaaagaccatcattcgtccccgcgaaactgcaaagataaaactcaaaaagattgccattaagacgtgcgtaaaaccagtcccaacctcactcagtcctttaataccggtgacgagtaacgccttcccgttttgaatcaattcactactatgaatggcttggttgacccatttatcaatattcttattcaataccgggtgattggtgattgctttagccagcatatctggaatgaccttcaactgatcgaccagggtaggcgccgcgtacgatagcgcaccgataaacaacgcaatcacgccgacgtagaccacaatgacggcaatccaataaggtaagtgcgttcggaggtttaaccaccgactaagcttaatgcccaaatacgcaaaaatcgtcgttaatagaacaactgtcgcaaacccgcgcattaaataaataatgatgattaataacgccaacgttaagtacaagtcaacgtcatcccgcttaaaaaaccgaatgattctatccataatttgcccccaatcgcatgttacttgcattatagcatgactatggattaatcccgcccaccgattccggccttaaattaaatttgacatttaaaataattaccagtatgataggtgtcaataattaaagaacgattaaaagatgagtaattggtgtcgctgttcagcgagtatcgggttggtgaaacggtatcggcacaaccaatgaagatggtcttctccctagttcgttttggtgagtgtctggtgagcaacaaagtaaccagcattaactaaagccggtttaacaaccgttacccgcgttagcaattgccaatcatttggcagctgtatcgagtagactagttcactagcctagaactcaggtggtaccacggcccaacgtcgtcctgaataatgattaatattattcaggacgacgttttttcgttcccaataaaatttaaggagtttgatatttaatgacaactacaactttaaccgccccattccgttttgacgtcgtcggcagcctactgcgccccgctagtttgaaaaaggcccatgaacaattagccgccggtaccattacgcgtgatcaagaacttgaaatccaacacactgaaatcaaacgagtggtcgctgaacaagttaagctcgggctcaaagccgtgaccgatggcgaattttcacgcagctggtggcacttagatttcctttggggcttaactggtgttggcaagtacgactaccatcaaagctataagttcaagggggaccatactcgaacggataacgctgaacttattggcaaagtcgcgtataatcccgaccatccgttctttgctgcctttgaatacttacaatcaatcattcccgctggcgtacgcgctaaacaaacgatcccatcaccaactatgttattccgcgataatcggagtgacaattggaccaaattctatgacagctgggatgcctatttaaatgatctcgcccaagcttatcacgataccattcaacatttttatgaccttgggtgtcgctatattcagttagacgatacgacgtgggccttcttaattagcaaactcaatgatcccgaagctgaccacgcggcctacactaagtgggcgaccgatgccgttaaagtgattaacgcagcattagctgacctaccgagcgacttgaccgtcacgacccacatctgccggggtaactttaaatccacgtacctcttctcgggcagttacgacgtggttgcaccctaccttggccagcttaactatgatgggctgttcttggaatatgataacgaacgggcgggtggcttcgaagcgttagaccagatttggaaccatgatgaccacaaacgcatcgtattaggtctggttacctctaagtttccagaattggaaaaaaccactgtgatcaaagaacgagttcaagctgcgaccactaaggtgccattgcgtaatctggcactatcgacccaatgtggctttgcttcaactgaagaaggtaaccagttaactgaggctcaacagtgggccaagttggcgttagtcattggtacggctaaggaagtctggccagaagcctaattacaacaactaaaaaagatcgagaatcaaccggcgcatttcaagcgtaatcgcttaaaaaatcagccagattctcgatctttttagttaccggttaaaccgggtccgccaccgtgccaagcgcggcgtcgtagtagccggtttagtcgccttagcaggcatgttcaatagaatcacacccgtaataatcgccatgaatcccaacgttttcaatcccgtcaagatttcgccaaacgcccaaattccaatcaggccggtcgcagctgtgccgactccggcccagattgcataaccaacactcagtgggattttgctcaatgcccgtgagaaactaaaaatcgctaggccgtatagtaacatgcccacaattccaaccaaggggtacttaaatccagccgataacttcaacaagctggtccccgcaatttcaacgccaatcgcaataactaattgaatccatgcacgcatcatcattcccccttgatttaaatgttcagtaaaatcgccccgactacgattgcaattaagccactcagacgtgagagactgagccgttcacggtaaacgacgaccgctaaaataacggttgcaaacgtgcccagtccagcccacatggcatacgtcacccctaacggcaggcgttgcattgcaagcgttacaaggactaacgaactaaaatatccaaccaacaccattatcgttggtattaagttccgaaaaccgtttgcgcgctttaagaaaaagctccctaaaacttccatgaaaatgccaccaaataataacccgtatgccatcttaatcacctcactaaaaatttcgttgtcctactattctacggaagtttatttaaaaaggcaatcaaaagatacgcctggctgattacagtttgatgacaaaaataaatcgtattctagactatgctacagcgatctagccatttaatttcaaaattattgttagctgagtggcgataactcattcagcttaacgagcgtacgcaatggttacgattcgaataccgtccagttgaaaaacttttcgcaataaaatgtcaataatcagcatttaagacgtcatccgcgactcaaatctcccgcatctaaaaaaaaaaaggaccaactcagcagctggtccccacagtcatccttaaatatagaaataaattgagaaaaacatcaacgtggttcccaccatcacgaataggtgccaaataacgtgtaaatatttaatccgtgggaaactatatagtaatgcacctaaggtaaacgcaacgcccccggcaactaataaccagaagccagtgacacctaaatggtcccataactgccgaccaccggcgaggcacatccaccccatcaacacataaatgaccgtttcgacctttttcaaacgtccaggccaaacagcattaaccgtaatcccagcaatcgctaaaatccaaatcgttaataagatcgtccagcccaaccaacccttaatcgccagtagactgtacggcgtgtatgtcccagcaatcagcacgtacacgccactgtgatcgaagatacgaaaaacttcgcgggcgcgcgtaaagtataatccgtgaaataacgtcgaacacgtatatagtacaaacaacgaacaaccatatataataaacgccgcccattcgaggggctgaccatccgcatatgccttgagcatcaaaaaaacaaatgcaacgatacttaaaataatcccaatcccatgagtcactgagttgaggacttcatttgttatttgatactgtcgcgccgactgtgccatgttaatcacctcatatttattattgacaccagcataccatcacatagtgtaaatatcaatacatctagtttataaaactaggtaattaacaaaaacataactagttcaaaaaatgacactgcgaaattaaccatttcgcggtgtcatgctaagcacaatcttatattcaagctaatcgtgcggtcctctaggccatggatatctataccagtgcccactacgaacccacagcgcttaccactcatcataactgatcagcggtaacacctattcaacctaattatcggcttcttcagcgtgagctgcgacctgctgaaaaatactaatgatatgtttatcggccagctggtagtgcacgttacgcccattgcgcgttcccacaactaattttaattgtttgaggaccgttaactgatgagacacattcgactgtgtcagggctaatcccgtcgccagttcacccacactcagcttagatacggccaacgcgtagataatccgggcacgcgtcggatcaccaagtgccttaaagattgcggtgatccgactcaactcatcagtcggcggcatcagttcagccaaccgtttgacgatcatttcatggtccatttcattttccatcataaactccaatttctaattgagattgtcatgtaagcgtgttacaatacacatgaacagtcattcatatgtttgctcattcatatttaaattatagccataacaaggataaattcaactaagaagtaggtgattcatatggcacacagccatcaaatacaacaacagaccagcgccttcaagattggggtcgccctaaatactgccttcattgtcttggaagctggctacggttttgcgagcggctcactggccctagttgccgatgcaggacacaatctcagcgacgtcctgggcttactgatctcctggctggcaatctggcttggacaaaaaagcgccaacgataagtacacatatgggtacaaaagctcatcaatcttggccgccctcttcaacgccgtctttttactagtcgctatcggggccatttcagtcgaggccatccagcgccttagtaatccgggtcccgtcgccgaatgggatgtcattatcgttgctgctgttggggtcgtcattaatggctttaccgcattactctttatgaagggccaaaagcacgatctcaatattaagggcgcttttctccacatggccgccgacgccggcgtctccatcggcgtggtcattgctggcttcatcatcttgaagactggctggttctggctagaccccgttgtttccctgctaattgccgtcgtgattttgattggtacttggggactcttacgagatgcgatgaattattcactagaagctgtaccaaacaatgttgaccgccaagcaatcgctgattatttaaccagccagcccaccgtcaaccagattcacgatttacacatttggggcatgagtactactgaaacagccatgaccgtccatctctgtcgttcaacattagctgacaataatgcctttttggaacaactgaacaaggacctaagcgcccagtttccactaacccacatcacgattcagattgaacttggcaaggtggattatgaaacaacggatagttcgatttagttcatcgtgagttaagttatgatacacagcatccaaatcgaatctgtttctgtataaactatctcttccgccttaaacgaccgcatgctattaagcatgcggtcgttttttgtcttacacattttcgttagtttgagacgccacggctcacttccaaactcatcaatattgactagctcggtaaactacgaccgttctcgttgttttggcttcaaaaagatagctaataccaaacttaatatcagtattgatgtgaccagcaagcgaccggccacttcaccaattatcgcagcggggccatcatcaacggcatgtgctaactcgttcagataactcggtactattgtattgatcagaatctcagcaataaatgcaataaacaccgtgatgacgataccgacacgcaatttacctgacttgaaccgctgccaatctgaaaaatacgacaataataccatggcgttcaccagtactaaaaacggtaccaaaaacgttcgtattccaaacggccgcaaatagtcaatgtagccaagtaccagtaacaagaaattgcatcgatacgagacgaccacccattttcggctcttctgatgaagtcgttctgcttccttataataagccagtaagtgatcatcccgcattaaatcgtctagccgaacgtcataaatatcactcaattgaactaaactgccaacatcgggaaaactgtggtcattttcccagcctgagattgttttgcgcgatacatgtaattgttcggccacttgcgattgtgtcaattgtgcgtgcttcctacacacttttagtttttcagagaatttcatatcagactttcgactactccctcatactttggttgccataacgcgattaaaaatcatgcttttttaccatgacctgatcaaaatgcacgttcattcgcacgcggctcacctttcttaaaaaacaacacttgaattaaaaagccaatagcaacaattacaaaaacaagattaatcagatttgtgccatttcgccaaaattcgcgacctaagacattaccgttaacaattgctggataaacgttagcgcttagcaatagtaaaacgattgcagcccagaatctgtagtatttgtagaaaacaagattaatcataaccaatcactcctaaatgtcttacttatatttgcaatttataataggtgtcttatcagataaatacaaccttcttaagtaaaaaaactagtctgtgttttccagacatgcaattaacccgctcatgctgggcatttagcacagtataaccatcagtctgatgcagtgagcatgatttttgtggataacgcttattcattcaaaatctatgcgccaaacgctataccgtttgctgaaacgttatggtactagaagtagttatcactaaccagtatccgagttagtcacactacgatgctaattaccagtcacaggttcaacgataccgcaacctcagcggtatcgttttgtcaaatattcagcatttttcgacgttcgtacgttaaattaagacattaacgcacattgcagcacacataacgtcattcattatataatttaagtaatatttattaattcagataatctggttcacttcattcttagctaaccacctaggaggcacttacatgagcatcatcaatcgcgttatcggtatcattatcacgcttatcttgttatgccaatggttgcttggctatcaattaccagctgccatggcgttcttcttagtggcctggctgattggcttggtaacgatgtggctgttgccagacacgacgaccgctaaccgctagtcgtgagagggatacaaaatcaactcattctaaaacacgtcacaaggccattacaacttgctcttgcgacgtgtttttgctaacttcactattacctagaaaacggttagactggttctacacgccagcatcaccgaccattcaaatatgtttttgccgcttaccctcattgtgaacttgcgtttcatattgcgatggaactaataatcacacttcccataactactccggattaaagcaccccccttgcttacattcacacattgatactcacaaagatacacaggcataagcacataaaaaaaggccagcatccgccagcctaattctacctaattcaatttaatcaatcccgccgccaacaaaaacatgtgggtgacgactggtccaacgaatgtcaaaccatgtcggtgtaaatccttcgcaacgcgggcgccaaggggtgagcgcgtcggtaattcatcatcgggcgccggcataatgattggtgtcgcatcgacaaacgcccacaggtagttgctaaagctaccatactcggcctgtaattgttgaatagcacgcgcatcctgaatgattgcacgtaacttacgaccattgtgcatcactttgggagtcaacatcagccgttcaaaatccggttcgtccagggcagctacggcgtctacccgcagccccgccatatgttgccgcaatactggtaactgactagccgcgacccgccagcctaaacccacttgtaagattccaaccactaacaattcaaataaaacgtgatcatcgtacgtgggagtaccgaagtaagcatcgtagtccttaaccccattcgccgtaatatcgtcaagatcatccggactaatcattattcgataaccaatagccattctcaattcggcctaacagcgtaatcaattgcttggtttcagcaacatcgtggacccggatgatccggccacccttaagcatcatcgctgcttcagtgaccaacgtcattggtaatcggtcttccttcttcaggccaagcaatagacctaaataacctttccgtgaaatagccaccatcattgggcgtcgcaagtaattaaattcatcaatgttacgcatcatcacgtaatcctgttccccatgtgcgacttgtgaatagccaatcccctgatctaaagcaattcgttcaatatcgatgccatgactcgtcaatgctgacagattttgttcaaagaaaccacgcatactgctcgtcagatcggtatattcttggtcacgactactgtgcatcgtcagtaagccgacgcgactgtcagccatcaatttgagcttgcgagggtcgtccgtaaaggcgttcacatcgttaataatgctgacaccttcttccaggacggcttgcatgacatcatacttataagtatcaaccgctaagactgcttccgggaaacgagccttgatggcgcgaatgtacggcaacgtccggtctaattcaacttgcggcgtgacttccgtgaaccccggccgtgtcgtttgaccattaacttcgattacgtcagctcctgcttgtaacatggcatccacgtgattcagtacgtcatctttagtcttgtactggccaccgtcgaaaaaggaatccggcgtaatattcatgatgccataaatcatcggcttcttggtgagattaaaccggtgctcacccgcttgccaaaaaacatcatattgtttcataatttgagtcaattgaatttgagtcgttgcttgatccgtaaagactcgcgaccattggtgggttaactggcgaccagctgtctggttcagcaagacggtcaactgttcaggactcgcctgcacgaccccatctaattgctgacatagttgggttaatcggagctgctgctcccgattataatcactaaaacgcaaaactaattgttgttgtcgttgaacttgggcattcaacgcctgactcgcaaaatccgttgcttgtgctaatgaactggtgatatcttgtactaacatctactccaccgatccttccaatttttaaagttttgtgattaattttaaggcggcccgtccccggtgtgtcagcgggatgcgccacgttgctggtaattcggccaaagtccgaccatagcgcggtagccagaaaattcggtcaaatccaccagaatagcgtccaaattgataggacgctatgtagccggtgatcgaagcttgtacggccaaggtccgcccatctggccaggcagccgctaacgtagcgcgcatcaccgcttgccgctcgttgttagggatatcgcgtagggccgttaaaatttcctgattgcgatcaaagccactgactgcaacccctaagtcgcgcgccgtggtcacacctaacaagtctggtaacgcggaaatctctaagccactatcatctgcgataaccggaacccttagctgttgcgccccaaaacgagctttagaaaccgcgttatcgacatagctcgtcgtcgtttccacgggaaattcgatccgcggcgccactgtcaagtactgacgagcagtcaagccataataagccaaacacgcgatcaagtcgcggcttttaccagcgttgttggatgcaatcaaccaagtcgtcgtcattggcttaaccccggccaaccagcctgttggagctcacgaatgacataaaatgaccccgttacaataatcgcactattactggttgcttgctgctgagcttgcgttaacgcatccgtgattgtcgttgcagtcaataagtctggctgtcgttgcatcgcagccgtggtcataaaggtgggcgttaataatgcggtcgccgtgtcggccagcttagtcgcggataacgctcgttctggatttgcgggcgtattcgtaatcaggacgtcagctaccggtaatagttcagccagcattttagggtaggccttatcttgtaagaccccgacgatccaaatcaatttacgaccagccagtaattgcttcacacttgccactagtgctgccatgccatccggattatgcgccccatcggcaataatgacaggttgctcctgtaacacggtcaaccggcctggcaaggaaacttgttgcaagcctcggcgaaccgcactgttcgtcaagttaacttgttgctgttgtagtactgcaaccacagttaaaaccaaccgcagattttgtagctgataggtgccactcagtccgaccgttaattgcgtccaatcaaaaagctgactgtgcgcatcaacgacggtttgcgtgagtgtttgcccagtcaccgtcagttgcgcgtgcttagcggtcactagccgaacaccttgattgagcgcttcggtctgcaaaacagccagggcttctgggtgttggtcagccaatgtcactgctgttgtatggggcttgatgatttttgacttattttgcgcaatcgcggtaatcgtgggcccaagaatggcggtatgatcgagggcaatcttagtaaataccgtgagttggggactggctaaggcgttagtcgcatcatacaagccgcccaaaccggcttcaatgaccgcccattgcacgttttgattccgaaaccaaacgacactaatgagaaagaaccattcaaagatggagacatcgctagctgtcagtcccatattttgcagaaccggtagaatctcacgatacgtatcgataaattccgctggactgatccacgtcccattgcattgcagttgttcacgcgcatcattaatcgcggggctgctgaagcggccaacttgatacccttgcgcccgcaggatactggctaacatagctcccgtagagcctttgccattagtcccagcgatatggatcacatggtaataatggtcagggtggccaagatgtgccatgatgcgccgtaataacggaacacgctgatgattattggctaacatggcttgatttagttgggctaataagtcctgataatgttgttcaatcgtccctgtatccactcaatcacctactttgcgattcgctgtaagaattctcgtttcaagtctaaatccgtcttgaattgaccactgtaatagctactttccgtatgcacacccggtttgctaacaccccgcatctccatgcacatgtgccgcgccgtgattgagaccgcgatcccagccgggtcaagaattcgttgtaattctgttgcaatggaaactgtcaaccgctcctgaacgttcggctgttgactgcaatagtcaatcaagcgaggaatcttactcaagccaatcacttgttcatgctgcggcacataagcaacttgaaccgtgccaaaaaacggcaaaaggtgatgctcacacatcgaatagaatggaatatccttaagtaataccatttcagtcggatgctcaaccttgaacagtttataattatcaaatggtgcggcggtcttagtagcgaaaacttccgcatacattcgtgcaacccgtgctggtgtttctactaatcccggtcggtcaggatcttcaccaactgcacttaaaatttctcgtactgcatgctcaatctttgcttggtttttctcatcaatcatctaactcactcacatttcttacttttttaatccaactctgatcctgattagccgcaatcaattgggccacttgtggtccaactaacacatcagttttggcgatttcagcagttggcagtagcacaaagttgcgcttagctgcctgcgcatgcggaatcgtcagcgtcgctgtgttgatttgccggtcgccccaaaaaataatatccaaatcaatcgtacgtggtccccagtgaaccaagcgttggcggtggcccgcctgctcaattgtatgtaattcatccaatagttcttctggtgtcaaattagtcgttaaggataccgaaacattgtaaaaattggcctgatcacgctttccccacggttgagtctcataccaatgagattcgtcaatcacgtttaccccattgacggctcgtaatcggctaagggcttgctgaatattttggacgcgcggatgaatattggaaccaacactcaaataaacccgttcttccctacttgccattcggcgtcccctccacctcaatttccacatcatcaaagattccaggcattggtacgctatatttacgaattttaatattgattgcatccgccgcgggaaaacttgtcaataacgtctgcaataagtggttagctagtgattcaatcaacttgtatgaatgggtcgttacaaattcatcgaccacgttacggaccgccgcgtaattgatggtctcgtgaacgtcatcgtgttgaaccttggtttcgataggatatttaatggcaatatctagccctagttgttgaccattacgccgttcttctggaagtaccccgttaaacgtgtgaaagcgtaaattattaattcgaatcatgcccataagtatcccagcctctttcttgctcatttttacttataatcatagcatgaaggacgctcaatatgatagtaatcagccaaataaccccataaaaactagcaatcgttcgggaaccgaaaaaagtgcgttgctaacaaaccggttcatcaaaaaagacgttgctggtcaaaaaaccagtaacgcctttgtcttagtttaaagcagtcgtacccccaccatgaactctaggaatccgtagtcgtcccatcattaaaattaatcaaattactgaggtaatggctagttagaccaggtgtctgcttcacaatataggtggcgagcggtgactgcgtcatttgcgtctgaataaagctcgtattgacgatgttcgccaacgacaacgcgacaaaaataaccagatacgtcacgacaaatgacacgattccacccgcaacactgttcacttgcttaataactggtagccacgtaatgctacgtgaaacacggcctaacaaccgaatcactgaccaccctaacgaaattaacacgaagaaagcgaccaggttaatgatcaacgttgccgccactgaagcttcaattaaatgtaaattcgtcaatagattactaatcattgtccctaacggctgatagagtagtcgtgcaaacaataggacgacgaccgtcccaatcagatgcaacatttcaatcacaaatccgcggtgaaacccgcgaaaaattgcgcttgctagtaaaattaaaatcacaatcgtaaatatcatctgcgtgccccgccttccgcttttcaggtacgcctattttaccagctttcgtcagtcagtgcagtgttttcacctagtctaaaccttatcttaaagacttgacgacgaccgtttctttcggtaaagttaacagtaatggttacgatttaaaaagaatggggttacaatacatggtcaaccgacggatatggctttatttggcaataatactgggactcagcggcctattagcaggctgtcaaagttcgagcacccccagtaaaacgactaacgacaaaattaatatcatggctagtctcgacttttatggtcaaacagctaaggcggtggcaggaaagtatggtcaagtgacctcgattattgatcgaccgagcgttgacccccacgactacgagccgaccgtcaacacggctaaacaggctagtagcgcccaattaatcatttacaacggcctcggctacgatgactggatggaaaagcttactgtcaacaaagccaagggcgcccgggtaatcacagtgggaaccgacgtggctcataaaactgacggggccaacgaacacgtctggtacgatcccacaacgatgcccaaattggcaactaaaatcgcaacagaactcagcaaaattcagccgcagcacaagcattattttgaacagcaggcccaaaagtatcagaccaacgctaagactataaccactatgatcaaacaattgaaacagcatgcaaataatcagcgtgtcgctgtcagtgagccggtctttgactactcattgaaggcaatcggctaccgaatcagcaatacgcatttcgcacatgcaattgaagagggttccgacccgtcacctaaggatatccagcaaatgcaacaagacatcaagcaccaccggattgcctttttcgttgaaaacactcagaccgatagtaacttggtcacgaacatggtcaaactcgccaggaaatacgatgtgccagtactgaaggtcaccgaaacgttaccggccaatcagacgtatcaaagctggatgctcagtcaatatcgtcaattggcaaagattcaaaaagcaacagccaagtagaagcgccccggttagttgggccaagtcctgtgattcagtacgatcacagtcgcgccacgaaaaaagggccgccattcttgattacaagaatggcggcccttttggcctaattacgcctaaccgaccgattgtgcaggcactaatgtctaattagtggcgttcaaagcatatcccacttaacttcagtcattctcgcctggtagtcagtcaccgtgattattaatgcgactgcttgcgcccatcacgcaaaagtaacgcaagcacgaggccaaccaattcaatgccgagcatcatccagaagaccgtatggtacccttgcaagttcgcacgcaacgttgaggctcccgcttgtttctgagcaagcgtcacgttggataagaccaaggtcgccacggccacaccagctgaaccgagaatttgacgaaccgtcgtaatcacagcggtaccgtgtgaaatcagttcatcgggtaatgaattagcccccaatgtgacggcgggcatcatgacaaaggcattcccgccttcaattaaggcagccagcaaaatcatggtgagcaggttcaactctgaattgatcagtgctaagatcagccaaccaacaacgatcatactcataccaagtaacatgatttgtttgtatccaatcttctctgctagtttcccagtaagcgggttcaaaatacttagaagcaccgcaccaggcaccagtgacatgcctgaaacgaatggcgacaccttcaagacaccctggtaatagagtgggaagatgattgttacgacaatcagcgccacgtacgagattgctgttaggaaaatggctaagtcataattaaatgtttttaagacccgtagttccaataacggcgtctccaagtgaaattggcgataagtaaagtaagccaccgctagtactgaaaccgctaataacagccaaccgaacgtccagttcacattgggtttaccaatctcattcacgacgtataaaatcccagcaaagcccagtaacgtcacgattgagagcaaatccagctttgaaggcttattgaccatcacgtccttgatcgttgtgaaactaattaggatcaacaaagttgccaccgtgatgaagacggcaaacaatccgtgccaatcggtaaacttcaaaaccacaccggaaataatcgggccagatgctaatgctgatcccatgaccaacccggcgacacccatcgtactaccccgtttttcctcgggcgtaatcgtcagtaaaatggattgatacgagggaaacagcacgccaactgccgccgctttaattaggcgaccgaccatcatcacaccaaaactgggtgcgaaataaataatgattgaaccaatatcgaaaagcaccaaaacggctaagaataatttcttaaacccaatattattcaacaaccacggactgattggcatcatgacgaccattgtcaacataaagccggtcgttaaccattgcacggttgaggccgagatgccaaagtcgcgcataaatgttgggtagaccgtcgacaaggaagactgactgatcgacatggtccaagtcccaagcaacagcgtaaaaatgaaccagaagcgtcgacgccccgtcaacgttacattttgattagctgtctgcattcaaaactcctccttactttagaacagttatcaactactaatatccattgtaccattgaaaccaatgatgtacaggctaaaagtcagattggcaacaaaaaagtttgctacaccgaataaagagacgtgcacaattagcttgtaacaacacccgcgtgaatgattgttaaatatccaatctgttaaagctctaacggacagattcattaagtcagttggcctctaatcatcataaaatcagtcccaaccagggcactccatcacaccgaaaagctttacagccaaactaaaaatgggttgttcaagaatcaaattcttgaacaacccattacctacatgttgcatcgatattcttaatttattcagctaacatggccgcactaactgcctgtagctgcttcgcttcaccagcagtcggtttagcgagtttcatcttctttaaggcgatcactgcccgatattgaagttccgccacattaatatcatcccgcaaatcataatgagtaattgtgacgaaggcggagttctcgtaaattttttcaactttagcataaaaatcataatcggtattgccgttcttttgacatttaacccgatcccccacagaaatctgagccataactatcactccacttcataaaatatgataataacatagcacgtaactgctagaataacaattattgctcccgaatttacatgatttttacatggttatgacggatactgtccaaattaaatgacattaggcccagcagccagtatttgcggttagtaatggccaagttcgtaaaccaatacctagtaccttagactgagctgaatcaccttatcgattgataactagcattcgatttttctaaccaaccaaacgtacgccatttacgcctgactctcaaaatccgagtgctactgtctctcgttttgacaactcccccatcactgccagctaccccaaatatgagcattgagcgcaatcgctaacgattcaactcaacggaaacttattcagtacaatgagtgtgattgcaaccaataagtagatcgtgccggtgattaatagtatgggttgaattccaaatgcgctgatgagtaccgggattcctaataatccgacccgccgtttgaatttccaaatttaggcttagttcgcccagtaggctaatttttggcaacaaaaaaaggaatcgaattaacgattccttaggttgcatggcaacgtcctaccctcgcagggagcgatcccccaactactctcggcgctaagaagcttaacttctgtgttcgacatgggaacaggtgtatccttctcgccatcgtcaccacactattgagaaacttgtgctctcaaaactagacaatatcaaatatcttcatatgaaccggaacaccaattacttggttaagtcctcgaccgattagtattagtccgcttcatgcgtcaccgcactgccacttctaacctatctacctgatcatctttcaggggtcttacttccataaaggaatgggaaatctcatctcgaggtgtgtttcacacttagatgctttcagcgtttatcacatccatacgtagctacccagcgatgcgcctggcggcacaactggtacaccagaggtatgtccatcccggtcctctcgtactaaggacaggtcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggtaccaccggatcactaagcccgactttcgtccctgctcgacctgtctgtctcgcagtcaagctcccttgtgcctttacactctgcgaatgatttccaaccattctgagggaacctttgggcgcctccgttactttttaggaggcgaccgccccagtcaaactgcccacctgacactgtctcccaccacgattagtggtgcgggttagagtggtcatacagcgagggtagtatcccaccaacgcctccaccgaaactagcgttccggtttctatggctcctacctatcctgtacaagctgtacaaacactcaatatcaagctacagtaaagctccatggggtctttccgtcctgtcgcgggtagtccgcatcttcacggacaatataatttcaccgagtctctcgttgagacagtgcccagatcgttacgcctttcgtgcgggtcggaacttacccgacaaggaatttcgctaccttaggaccgttatagttacggccgccgtttactggggcttcaattctgagcttcgccgaagctaacccatccttttaaccttccagcaccgggcaggcgtcagcccctatacgtcatcttacgattttgcagagacctgtgtttttgataaacagtcgcctgggcctattcactgcggctgatcttgcgatcagcaccccttctcccgaagttacggggtcattttgccgagttccttaacgagagttcactcgctcaccttaggattctctcctcgactacctgtgtcggtttgcggtacgggtagttaagtactcactagaagcttttctcggcagtgtgacatcagacgcttcgctactaaacttcgctccccatcacagcttgtccttaaagtgaaaagcatttgactcctcacaagacttactgcttggacattctaatccaacagaatgcacatcttagcctcctgcgtccctccattgctcaaacgcacttaactagtacaggaatctcaacctgttatccatcgtctacgcctctcggcctcgacttaggtcccgactaaccctgggaggacgagccttccccaggaaaccttagtcattcggtggataggattctcacctatctttcgctactcataccggcattctcacttctaagcgctccacaagtcctcacgatcttgcttcaccgcccttagaacgctctcctatcacgcgacctaatggtcgcatccatggtttcggtagtatgcttagccccggtacattttcggcgcagaatcactcgactagtgagctattacgcactctttaaatggtggctgcttctgagccaacatcctagttgtctatgcaactccacatccttttccacttagcatacatttagggaccttaactgatggtctgggctgttcccctttcgacggtggatcttatcactcatcgtctgactcccggatatgaatcaatggcattcggagtttatctgaattcagtaacccaagacgggcccctagtccaaatagtgctctacctccatgatcctaattccgaggctagccctaaagctatttcggagagaaccagctatctccaagttcgtttggaatttcaccgctatccacatctcatcccagcaattttcaacttacacgggttcggtcctccagtgcgttttaccgcaccttcaacctggacatggataggtcacctggtttcgggtctataacctcgtactcaaaacgcccatttcagactcgctttcgctacggctccgactttttagtcttaaccttgcacgggatcataactcgccggttcattctacaaaaggcacgccatcacgcattaacgcgctctgacttattgtaggcacatggtttcaggaactatttcactcccctcccggggtgcttttcacctttccctcacggtactggttcactatcggtcactaggtagtatttagccttgggagatggtcctcccggattccgacggaatttcacgtgttccgccgtactcaggatcctgaactgagagaatttgatttaatctactgggctatcaccatctatggcggattttcccaaatccttcgactatcaagttctttggtaactcaaatgttcagtcctacaaccccaaagtgcaagcactttggtttgggctgttccccgttcgctcgccgctacttagggaatcgaaatttctttatattcctgctgctaatgagatgtttcagttcacagcgtttacctccaactagactatgaattcatctagtggtaacagttgattaaaactgctgggttgccccattcggaaatctccggatcatagcttacgtacagctccccgaagcatatcggtgttagtcccgtccttcatcggctcctagtgccaaggcattcaccatgcgcccttgttaacttaacctcatttacctaacggtaaatgcgattaatgagtttagcgataattaaacttcaataaaaaactcaaaaaacgcggtgttctcggtttcattatgaaaaaatatatttgatattatctagttttcaaagaacaagttttgagagttaaatctctcaaaactaaacaaagtttcgacgcgtgtgtaggtttccgtaatattccttagaaaggaggtgatccagccgcaggttctcctacggctaccttgttacgacttcaccctaatcatctgtcccaccttaggcggctggttcctaaaaggttaccccaccgactttgggtgttacaaactctcatggtgtgacgggcggtgtgtacaaggcccgggaacgtattcaccgcggcatgctgatccgcgattactagcgattccgacttcatgtaggcgagttgcagcctacaatccgaactgagaatggctttaagagattagcttactctcgcgagttcgcaactcgttgtaccatccattgtagcacgtgtgtagcccaggtcataaggggcatgatgatttgacgtcatccccaccttcctccggtttgtcaccggcagtctcaccagagtgcccaacttaatgctggcaactgataataagggttgcgctcgttgcgggacttaacccaacatctcacgacacgagctgacgacaaccatgcaccacctgtatccatgtccccgaagggaacgtctaatctcttagatttgcatagtatgtcaagacctggtaaggttcttcgcgtagcttcgaattaaaccacatgctccaccgcttgtgcgggcccccgtcaattcctttgagtttcagccttgcggccgtactccccaggcggaatgcttaatgcgttagctgcagcactgaagggcggaaaccctccaacacttagcattcatcgtttacggtatggactaccagggtatctaatcctgtttgctacccatactttcgagcctcagcgtcagttacagaccagacagccgccttcgccactggtgttcttccatatatctacgcatttcaccgctacacatggagttccactgtcctcttctgcactcaagtttcccagtttccgatgcacttcttcggttgagccgaaggctttcacatcagacttaaaaaaccgcctgcgctcgctttacgcccaataaatccggacaacgcttgccacctacgtattaccgcggctgctggcacgtagttagccgtggctttctggttaaataccgtcaatacctgaacagttactctcagatatgttcttctttaacaacagagttttacgagccgaaacccttcttcactcacgcggcgttgctccatcagactttcgtccattgtggaagattccctactgctgcctcccgtaggagtttgggccgtgtctcagtcccaatgtggccgattaccctctcaggtcggctacgtatcattgccatggtgagccgttaccccaccatctagctaatacgccgcgggaccatccaaaagtgatagccgaagccatctttcaaactcggaccatgcggtccaagttgttatgcggtattagcatctgtttccaggtgttatcccccgcttctgggcaggtttcccacgtgttactcaccagttcgccactcactcaaatgtaaatcatgatgcaagcaccaatcaataccagagttcgttcgacttgcatgtattaggcacgccgccagcgttcgtcctgagccaggatcaaactctcaaattaatgatgagttctaaaaagctcatttaatgttgtactaaaatttatttgctagcgaattgacttcgcaaatgttttgctcttgattcaaaatcaagagaccctacacatttgattcgtcgaaactttgttcagttttcaaagatctaattccgtgtgttaatcgcttaacacaccttaatcatcataacatcttaatcaatatcttgtcaacaactttttttaagaagtaacttgattaatttgtcatagttgccgttgcgacaacagaaactatcttaccaattactgaagaaattgtcaacaactaatttcaataattatttggtggtgagatgcatctgccgtagcagcaacgtttactaatataccaattgaagtaaaaagtgtcaacactttttctgaatttctttttattaatagtcaaaccagctttctttctctatactatttaattaaaggagcgactaaattatgctagcttggctaccattctttttgatttcattaatgtttattgttctactatacgcttgtgcgcgatcagcgcgcacaaatatccagcgttttaagcaactcagtttaattgcctttctctgggtcttaactgctttttgctatacacctaccagttacaattttggtacccaactcgttattcaatatattcaatggggacccgttaagctgaacgtgattcctttccaacaacttgacattgaattttggctcaacgttctcctcactgttccattgggcggtttactggcatggaattttcccgacttgccttggcgtcgttttatttggttgggatttcttacggggctaacactcgagctgggacaattcatccttgactggttggttaacctcaaacgttgggttgatatcgatgatgtcatcacaaattgggctggtgtcattatcggtgccgctggttataaaattgcacgtcatgttcccgaacttcgctggttgcaaaaataacgtatatatagaagcaaaaagcaaaacaacgtttgtttagcacccacaagtgccaaacacttcagcgctctagctgttatgaaatcgtaattaaataagcgtcgcagccacttaaggttgcgacgcttatttaatttaactactaactattaatgaagctgccatcatcaggattcaaaaaacagatcgaatactcgcttacgatcttggttccagacttgattgtcactagttggataaactcgatttgttaacacaaccagcccaatttgacgatccaaatcaaaagcaactgccgggccagtaaaaccagtatggaaatattgatgtcgtcccgcacgtcgttcccaacctaacgtccggccattttcgtcatactcgcctaaccagtcaaagacattttcatccagcacccgtttgccttgatattcaccaaagtttaacatcatttcaataaatacggataaatccgtcagcgttgagaacaagcctgcgtgaccactctcaccattcaacaaaaaggctttataatcatgcacctgtccttgaatctgaccccgccgcggatcaaactccgtcggcacaaaccgaatcttcggacgatttaagttataacccgtattggtcatcgctagtggatagcaaacgtggtcttgaatactccgagccaatgagccgtcaaccgcacgaataatccatcccaataaaataaatcccaggtctgaatagacatacgttgtccctggcgccgtgacgagtggcgcatcataaaccgctttgatcagatcttcacgttgcatcttatccaggttatcaatatctgccggtagcccactattatgaagtaacaagtttttaatcgttatttcaggatgagtgaacccaggtaaaaaccgggcaaccgagtccgttaaatgaatcgtgtggtccgataacaactgaaaaatcctcgtcgtggtccctacaaccttagttaccgatgctaggtcataaatcatcgcaggatctaagcccacggcaaactcatcgcggccctgcttaccatgatagtattgattgatacctttaggggtgatcaagctaaacgacgccccataaatgtcgccagcttcaatacaactgtcaatatattgttcaattttttcgagcatccgcattacgcccacctttcactacattcactagtttctgcttatcttctttatgataacgaacttcctcataaaatcaacggcaaacgcttttaacaccctccacacctcgttgcactttttattaattaactagttaaacacttgttacattatggacaatattccacttatatatcaaaacaagtcttgtttttagccgttttctaaatataattaagtgaattaccaatgcctatctagctatgtaagtactgttatatcaacgttaatagtcaacttttcaataatagattgcaaaaaaataacccaaacgtgaaataaatcacctgaaagcggttacaaatccagcaaaaaatgttatgattcaaatatagaattttatcaatcatttgattggattcaaattatggaggcgagaaaatgattacatcagaaaagacaacaaaaccagcagcttggaaaggtttcaaaggcgggcactggcaggaagaaatcaacattcgtgattttattcaaaataacttcacacagtacaatggcgacgaaagcttcctggccggaccaacagccgctactaagaccttgaatgacaaagtcttagaattaaagaaacaagaacgtgccgctggtggtgtgttggatgctgatactaaagtcgttgcaacgattacttcacacggccctggttatattcaaaaagatctcgaaaagattgttggtctccagactgacaagcctttgaagcgggccttcatgccatttggtggtattcgaatggctgatgacgctttgaaatcatacggttatacccctgatgaagaaaacgacaagattttcactgaatatcgcaagactcataaccaaggcgtcttcgatgtttatactcctgacatgcggaaagcacgtcactacaagatcatcaccggactaccagatgcatacgcacgtggccgtctcattcctgatcttccacgggtcgctgtttatgggatcgatcgtttaatggaagacaaagctaatgactttgcccacattggtgatggtgaattgactgatgatgttattcgcctccgtgaagaagttcaagatcaataccgtgctttagcagatatgaagaagatggctgccagttatggctacgatattagcaagcctgcaactaatgctcaagaagctattcaatggatgtacttcgcttacttagctgctatcaagacccaaaacggcgctgcaatgtccgttggccggattgatacaacgatggacatcttcatccaacgtgacttggacaatggtgttctggacgaaagccaagctcaagaattaattgatcaattcgtcatgaaactacggatggttcggttcatccgtactgaagaatacaattctctcttctctggtgacccaatctgggcaaccttatcaatgtgtggtttaggcgtcgacggtcaacaccatgtgactaagactgctttccggattttaaagactttggacaacatgggcgccgcaccagaaccaaacatcacgattttatggtcagaccgcttaccagaagacttcaaacgttacgcaactgaagtttcaatcgacagttcaaccattcagtatgaaaatgatgacttgatgcgggtacaatggggtaccgattattatggcattgcttgctgtgtttccgcacaaccaattgctgatggaatccagtacttcggtgcccgggcaaacttagccaaagcgattctttatgccatcaatggtggccgcgacgaaattgctggagatcaagttggccctgcttacgaaccaattacttcagaatacatcgattacgacgaattcatgaagaaattagacaagcaaatggattggttagctgacacttacgttaactcactgaatgcaattcattatatgcatgataagtactactatgaagctgcccaattagctttgaagaatactgatcttgatcggacctttgcaactgggatttctggcttatcacatgccgcggattcaatctcagctatcaagtatggtcacgttaaagtaattcgtgacgaacgtggtatcgccgttgacttcaaagccgacaatgactacccacgttatgggaacaatgacgatcgcgctgatgacattgctaaatggttagtcaaagaattatacagcaagatgaacacgcatcacctctatcggaatgccaaactttcaacttctgttttgacgattacctccaacgttgtttatggtaagaacactggtaccacgccaaatggccgtcaaaaaggcgaaccattctcaccaggtgctaaccctgcatacggtgctgaaaagagtggtgcattagcttcacttctttcaactgccaaattaccataccgttacgcaactgacgggatttccaacacgttcggcgttacccctaacacgttaggccatgacctcgaatcacggaaagacacgttagtaaacatgttagacggttacatgaagaacgatgggatgcacttgaacatcaacgtcttcaataaagacactttgattgatgctcagaaacaccctgaagaatacccaacattaacggttcgggtttctggctactgtgtctacttcgcagatttaaccaaggaacaacaagatgacgttatttcacggacattcttcgaatcaatgtaacatttaatctttaatagttaagaaggcgaaaggctcatggaaaacaaacaagtttcaacaacgcaagcggcggcaaaggagcctttgataggctacgttcactccatcgaaacgtttggctccgttgacggaccaggtatccgttacgtggcattccttcaaggatgccacatgcgttgccaatactgtcacaaccctgatacttggaaactcaacgttggcgatcaaatgacggccgacgagattctcgaagacgcggctaaataccgggctttctggggcaagacgggtggcatcacagtcagtggtggtgaatcactggtacaaatcgacttcatcttagacttattcgaaaaagccaaggcgatgaatatcagtacttgtctggatacctctggacagccttttacccgagaacaacctttctttgacaagttcgaacgtctaatgaaggtcacggacatttcgttggtcgacattaagcacatcgattctgccaaacacaagcagttgacccagtatgggaacgaaaatatcttggatatgattcagtacatggcccaacaccacgatgatatgtggattcgtcacgtcctggttccccaacggactgattacgatgaagacttgaagaaactcggcgattacattgctaaaattccaaacgacgtcgttcaaaaagtcgaagtattgccgtaccatactttgggcgttaaaaaatatcatgaaatgaagatcaagtaccggcttgaaggaatcgagtctccaacccaagatcgggtggcaaatgccgaaaagctactgcacactgctgattacaacgggtacaagacatggatgccattgccaaaactttaaatcggcatttctagcatgactaaaacaccagcgatacaatcgtctacggatggttgtgtcactggtgtttttttgctggctcgacgcatacacgtattgctggctggaattagcacagcggcacgcaaaaaaggcgccgcgagcctaaaccagcaacgtctttccttaatcatgccctatccaatgaccgtcagcccttggactggctgcgaacaggccggccactaactatgaatgcctagttccattcgagcttcgcgggacatcatactttcgttccaagcaggttcccacacaatctcaatctcgatattgttaacttctggtaatttgatcagttcatcgtgaatgtccttagccaaccattcggtcaaaggacagcccgcaatggtcaacgtcatggtaatttcagcggtcccctccgccgtcaattgtgcatcatagatcaaccccaagttaactagatcaattcctaattcagggtcaatgacatgtcctagcgcctcgaaggcccggtctttaaacgttgttgtcatcgtatctcgtccttccataccagcttgaattcactgattaatcacgccaacgtttcgcggtataagtgccaccacacttgatacacgtcatcgttatataaagcgctttcttgtctacttctattgtaccgtatgtcagcccatattcaatcaattattagcgctaattaaccgacttttcaaacggtcggtcaatcagcaaattatgcgactatttctcgaaaaaaattcactataatccccgatatagcagcgttttgagtcactattgatttttattgcgaattcgcggttgtttttgttgtaagcgcttgcggtttatgctattatactaagtgaggaaaggaattaatcctcgattagcaaagcttctcaaaagagtttggctgtcgctgtaatgttagacagctagtatcacagtttgggtcgttatcgaaaccgttttaagcgccgtgaagcgttatcggtctagcgagtgtcgtgagatttacgttggatgactgaacgttgacccttagataaacgataaccgcaaagaattaattggcattagaatgacgaacagattttaactaagttttagttggaaacaggtgtctccgatgaccagttgttagttccacattaccagttccatttgtagactcaggtattacaaagtttaaacggaggtgcatgtctgttacgaagacattcccaagttttaaacgcgagtttgactttcgttaaaacccgtctaacgagtcgcaatcaagtaacaaccttactttagatcgactatagcagatagttacaataaatacgggttagtccgttagaagttggacacgcgtaaaattgaatagcatgaaggtgtatcatattaacactgaacaatttttcattgctaatcaggattattcctcataagtagaactcaagcagagaagccttgggttctatttttttgctctaaaatcagatttaccaacagtcggcaccagacgtaaccgtttacatactcttacgaaaaccgtatactgaatttaaatcaagttgcacattgaggaggactttagttttgaaaacgattaatttaggtcacagcaatattcaagcttccagcgtggcacttggcatcatgcgcatggacgctttggacgtcgcccaagccaccaaggttatcgataccgctgctgatttaggcatcaattacgttgattcagctgatatctacggtggtggtcaatcatcgaccatcttcggtcaagcactcaagcaggctcacgtatcgcgtgatcagctctatattcagtcaaaaggcggcattgttcctggcaagcgttacgacttttccaaacagcacatactggcagccgtggatggcgagcttcaacgcttaggtgttgattatctcgacaccttcctcctccatcgaccggacgccctgatggaacccgaagaagttgctgccgcttttgacaagttgcaaactagcggcaaggtgcgccactttggcgtctctaacttcaatcccatgcaagttgacatgcttcaagcggcactaaaccaacggctcatcatcaaccaactccaatttggtatcatgcataccggtgcgatcgactttggcttgcacacgaacatgcaggacgaacgtagtcttaaccacgacggcgagatgatcgaatactcacggctccataagatgacgattcaagcttggtcgccttatcaatacggtaacttcgcgggtatcttcttagacaatccgaagtttccagaacttaataatgccatgcaagcactcgccgatgagaaacaggtcactaaatcagctattgcgaccgcatggattctccggcacccagcccacttccaagtcatccttggtacgatgaatccggaacatctagctcaaaatgctgctggagcagacgttacgctttctcggcaagaatggtacgacatttactttgcagctggcaacgatttaccttaatcacgatcgacctaacagaattgacgattagtttttacaaccaaaacgacgaccccaaatcaagattgattttcaggtcgtcgttttttagacgtttcactaacatttttgatgtactcaccacatctacgcgtatacttaatcctatcaagactcaggaggcgagcgaatgacatccacttgcacgatctgtgaacgaatcaaactaattcaggcacatcagaatccttatttcgtttacgaactcacaacgggctacgtggtccttgctgatagccagtactttgaaggctacacgctctttttagccaaacatcacgttaccgaattacatcatttaccggcacacgagaagttacgataccttgaagagatgagtatcgtcccggaagcttgtgcgcaggcctttcatgcagacaaaatgaacattgaactactcgggaatggtgacgcgcatgttcattggcacttatttcctcgccataacggtgatacgcccaaccccggtcccgtctggtggacaccgctggaaacaatttatggtgatgatgtcagtctagacattccccgtttaagccggttaaagcgcacgctcagcgtagcaattgaggccacgcttaatgctcgggaagcagaattgcaggctttagaggcactcacaaggcctgctagccacagaattgacagcaattagaccaaatcaggacccagaccgcttagatcttggtggctacaccccaattcttaatcgcaatccgtcaccgtatttcaaattgccaaaatccacctatttatccgaccgactatcatacgctcgcttagatttatagccagctcgaaaaaccgtcttcataacttcaatgtgccgttccttagttgcttgtgccttagttccaaaaataaagcgggcccattcgcgctgataaccaggtgtcaaagccacaaagaacgtttgcaattcagcatcaatcgctaacaattcggttaccgccggaatatttttttcaaatgaactgaggggtgctgtactcataatcaaacctccgattagttttacttaaatttactgtaagaaagggaaaatccctaattttcaggcttttatatttcgaattttcacaaaattgcgctatcattatagtataagtattattatttgactactataattaaccatactgctattcaccaaggggagccctgctatgccaaaatttgatatcaccctcatcagtcccgaacgcgctaaagcgatgttgactgaatacaaagaacaacgtaaaaactctgtcccacatctggcccatcctggccgctatatcttgccggattacaaactaactcgtcgccgggccgcattcaaaattgttaaacatacctttttaacgccccactacaagtcttacgttgccatggactctgacaacggccacacactctggtttcataatttcggttccctaaccgaagctttattctggttagaaaccggccttaaaatcagcgataccgactcccattctaactacaaggaatggatggctaagcacactacggaaatcgaaaccttcaaagacttgctgcgcgagcagaagcataaacaagggcccaagactaagaaaaaagccaagtagcccgttttggcacctagattcagataagcagcagtacgcccattagcgtgctgctgcttttatttacgatcaactgtgccattcattactgactaggccaacctaaaagtggctatccaaaaacgactgcagcttgcgtgcaatcacgcgatgaccggcattgttcggatgcaaagtatccaccgaataaatggccgcttgagcgggaatcgcaaacgtcattcccgcatcacggtacaagctcaaatgtgggacgccatagtccgcagtcatctgggcaatcgctgcttcataatctgactgacgatacccgagaccattagtcaccgcactaaaactgccgccaaaatcagagccaatatgaattgctgaaataaataacttcggcacggtcggccaattcgtctgtaatcccgtcagtaacaccattaacgcgccataaaatgtcgtcatatcgcaatcaccgtattgccctaatggctgattccgaccatagtcattgacgcccccaaagacagcaataaaatcagcatcttcaggaatagcttgatagcgcgccgccatcgcatcgtagcgactcccaatcgttgaaccagagattcccaaattatcgctccgctcgacatcccaatcagccgccaaaatatcatgataatgcaccgtcgccaacccattattcgccgtaatcgaatctcccaaccacgccggccgcttaaaactaacgtgcccattactaatcgccatagccaatcctccctttactatcatcgctaccattctaatccatcccacctgaattatggtagaaagatgcctttatttaaagtcaacagccaccagcttaggcccgctggaaacagttccggttagcgtaaacctgcttagttcgttcgtcctacgccgccctccaggcatttctgccaattgctggaacgcggtggacacagatttaagccgaagaccacgtcttaaatactggtcttccactaaccaagccaaggacgcttgctaagtggaatttcaccgctgagcattggccgaaacgccttccagtcgggacagtattcgaatggcggacgaagatgtacccaacttttgatgaatttgtcattgttctccataaacagtaattttgttaatcaactgttaggtcgaaaagatattgggatagctcgctatttcggaattactatagtaataatagaacacctcaacaaagtggttagggtaaccctaacgtctcgtttaaagttcctgtatcaaaataaccaacgaccaattgtgccgagttaagtggccgttcatcagccattcgagcggcttaccgaaacgtgttcggtgccactaaagtctgtgcttgctatgccaacggacaaatgcccaaaccgcattaatccgttggctagacaatgctcggcttcaacccgtggcttgagactggaggggctgggtgacaatgctcagtagccaaattattcttagtcggaagtgatttccttccggcttagaataagactcgtatttgagatgacgcgggttatgcgttagctcaaatcgatgtcggctgcgttccagcaattgtcacccagccccggaggtcggaataggacgctcaccggctgacgaacagaaaaccaaccctaaaaggcatctttctaccattatttcaaacaggtgggccaatcttaaaaggctcgtattatggaaatccataatacgagcctagtttaattgatatatttagttcaactgagtagcgctaatcggcttccgtttcacgtttccgtgcagtacgccgttcgcgtgcgtagtcagttttagttgtgatttcaacgtcacgtgctagccgtttccggcgtgctaattcagctgctttggcattggctttcgcagcttccttgactggatcagtcgttaagtcgtgatggatcgagtacagtaagacgagcgcgacaatcgttaatgggaagccagacatcgcacagatggactgaatcgattcaaagccaccgaccgtgacaagccccaatgagaagactaggaagataacgacccagctcatccgattgaaacgacttggttgttcccccgcggccaactttttactagtaaatgacgaggtaatgaaggcaaatgaagataccgtcgttgctaagaaaataaagcaagataggcagtacaaagccagcataatcatcttcaatggtaaggtcgacaatactgctgcaatcacagcggcttgtccttgcgtatttaagatatgaactaagttaacgatgcccatccgttgcaagtataaggcataaccacccaagatggcgtagaaactgacacaacctaatgagccccatagcaacataccaccgagtacctgacgaatcgtccggccccgagaaatccgggcaatgaataagcccatgactggcataaaggataaccaccagccccagtagaagatcgtctgccgttgcatggccgttgcgtgaccatttggtgcggtattcgtactcaacgtaataaacttattgacaaacaagccaatactattagtttctgagtttaaaatatacaaagttgggccaacgattaaaacaacgattaagaagccaatcgctaaccaaacatgggcagcacttagccgaccgatccccttcttcaagccattgaaaacagccatggcgaagattacgaacaataaggcaaataaccctaactttaaagtcatcgtatcggcgataccggtaacggcactcaaaacttttgaaatgacaggaatttccatcccgactgaagtaccaacaccacccataatcccaataataacgagaaaatcaatcgtattccgggcaatttgcttacccttaccaggaccttgtagtactgaaatcgcggcactgagccgctgaaccttgatgtgtttaacatacattgcataggcaattgcaatcgtggctggcgcaaacatcatccacgccattggtccccaattaaattgtcccagcatgtgcgcataattatatgcagaagttgaaaacggcttgacgccgaatgaagggctttggagataccgtaacgggtcaaccatgctcaacattaagatgctggcatcgatcccagtcgcgtaaaccatactgccccagtgatacgttgaaaattctggtttgtcatcgggatcaccaagtttggtcttccctaacttactaaaccctaagtaaatgaaaaagataaaagtgatcacatataccgacatgtagagccagctcatgttgtttgtgagccaattcaagatgccacttaaacttgtctccagtgaatgccctcccattaataaaacaacggaagccgccgcaaagagaccaattgttggtaaatagacccaccaatcaatattcttactttttaaaataataaacctgctactgagcatatactctctatatttagatcaaattcgtggttcttcctaccagcaatggtagtccccacgcgtaaatttccgactagcaatcggtacacccctccgagttaatcctcggagcactcagcaccctgactgtatcaggtttgaccggcattgtcatccgcattctgtttgtgctaactcaaaatcagtagcagaatttccttctttccgttggttgaatccggacaacgccatactgacaaatgatttttaattgcttaatcgacgttggtgttcatcttgtttagctagtgtttctattaccatcgtgcctttagcacacgaccgtcgtcacaccacgtaacgattaatggttacactgctcttgctaatagataacccccttgaatcaccagataagcccaccgcacaactgttagattaattgcttggtgcaccaaaaaagcgcttagtaccgggtaacaagttaccacctgcacagcgcacgttggcttatacaaatgctgatttcagtattttctgatatctgatgttcgtttataagtatactagtattaaatcagaagtaaaatcaaccattttgagccgtcgaggcctaacccgtcaaggattagacgagttttacacccatattttttctgaaactttttaaaagttttcgtaataattagtttttagtttagaatcattcttatctgtttcaattaaaccgatttcatgttattcttgtaacaagtaaaaaaacgttatcatctaaaaggaggggaactgcatgcggcactactataaattaattttaacggtcagcgtcggtatcattgcggttattttacagtttggtttgcactaccaattggcagcacaaatcatcattacattaatggggtcacttatggccttatcaatgttagttgagatgatcaaaaccttacgttcaggtaagtacggggttgatttattagcaattacggcgattgtggcaacactagctgtcggcgaatattgggctagccttgtcgttctaattatgctcactgggggtgactcgttagaagattatgcggccaaacgagcgaataccgaattgaaagccttgctcgataattcaccacgtattgcccaccgctcagtcgccggccaattaacagatattgccgttgaagatgtccaaattggtgatcagctagtcgtcaaacctggtgagctagttccagtagacggtcaccttattcaaggaacggcactctttgatgaatcttcattgacgggtgaatctaaaccagtcgacaagcacgttggcgatgacattatgtctggtgcggtcaacggcgatagtgccgttacaatggttgttgataaattagccattgatagtcaataccaacagttagtcaaattggttaaagaatccgaatcacgaccagccaaattcgtacggctggccgatcgctatgcagtcccattcaccttggtagcatacgtcattgccggagtagcttgggcattcagcggtgatccccaccgatttgccgcagtcctcgtagtggcttcaccttgcccgctgattctcgccgcacccgttgcactcgtctcagggatgagccgaactagtcggaacggaatcgtggtcaagactggggacatgttggagaagttatctacggctaagtccgccgcgtttgataagacggggaccattaccagtggtcaattaacagtcaaccaaattgttcctcagcctggttttactgccgaacaaatcttgcacctcgcagcgagcgctgaacaaaactcaagtcatatcctggcccgctcactcgtcaagtatgcgagtgccactagcctcagcccggcaacacaattagcagaagtaacgggtaatggggtcacggcaacgattgagcagcaacaggtcaaagtgggcaaacttaaattcgtcgcaccgactacaaccgccaagccacttgctactactgctatctacgtcggcatcgatgaccagtacgcgggttacatcacgtttatcgacaatgtccgccccgaagcagccgccacgcttaaagcactccacgctgagggcgttcaaaacgtcatgatgcttactggcgaccaacaggcaattgctgatcatattgccgccgatgtcggtatcgataccgttgctgccgacctcctacccgcagataagattgcccacttaaaggctgtaccagcggccgaacgccccgttatcatggttggtgatggtgttaatgacgcgccttccttggctgttgctgacgtcggcatcgccatgggcgcccatggctcaactgctgctagtgaatcggccgacgtcgtcatcttaaaagacgatctcagtcgcgtggtcacggcggtgcgcattgctaaagataccatgcaagtggctaaacaagccgtttggattgggattgctatctgtacgatcttgatgctgattgccagcactggtatcattcccgcactctttggcgctatgcttcaagaagttgttgatacagtctcaattctttgggcgctacgtgcattacgggatcggccacaatcatcagtctcatcaacaaccacaactcccataacaaaggatgtgagctaaccatgccagaatggctcttacgatgggcacaatcggcactgacttttgtcgttgttttaacgttcgtttcagtcgttttactcaacgtaccactaaaagaagcaattctcgttgattttgcttacatgctattaacgctcgccttcgattggtaccgcagtcggcaccatgcctcgcgctaattattcaatctaatagtcactaacgatggttttaccaatcattaatcaaaaaaatcgttcccagatgtcttcttgggaacgatttttttagttaatgctcaatgcttcggtttagggtgagaccgtccacttacattcaagccttacttggccaacatataactaacttttacgtcgtccataatcgtggcaagtggtaccacatcatcaagcaaaattgaataccaatgtttcttattcataagatagcccggtaaataatgttgtccatcaatcagcatagataagtcttctgggcgcgctcgcaaatctaataccgtcacaacatgtgttgcgcccggcaacgccagtttatcggaagttaccgtcaataatgcgccataccatttgtgcgtgtctgagcgtcgccaaaccgcgttttgtggaaatttaggccacaagaactcaagatcgtcaccataaacagctttgacttgcgcaatcagcttacgctccggggccgattggaagacgtcattatcgtaacaatgctgttcgatgttgtataaaacatcttgataagcctgcgctacttgacctacaaactgaccatgggcttgggatgtcaggtgtaaaacatatacttcactagtcgtcgtatccgttaatgtcgtgttcagactgccatcagtgttcaactcgattatcatttcaaattggccttgcataattaaagttcggaactgatactgaccattctgattgggttcaaatccaaactgactgagtttgctcatattgacccgtttattctcaaatctaactcttgccatctgctgcgcctccaacttcattcccacttatcctgaatgtgatgctcgactattgcaatccacaaacaagtcaacgcactcgttgtcgtttgatagccgctatatcattttataagtaatcacccgtaaagccaattcaattgaccattgctgtgttagtaagccgacctttcacaacaattaccattgttccaatcagccaatacttgcgctaaagctcagctaatcttgaaaagacttcactaactcgtttttattgtttttttatacccgtccagccacaatctatggcacaatagttgataagtactggcaattgatgacctacttggttctttaaaccagcataacacaatcattttggctcgtggtattaacacatacatatcgttggttatgacctgaccctgtaccaaatatctttttggtcagcacagaaccatgtctgtgctgaccaatttactaaataataacggaggtcctaatttgaaaaaatatcgcgattatcgtaccgccattgcccgaacattgaccatgattcaacctaccgatgaaggcctcgccaagggtgccaaagcgattcaggaaatcttaaacctggcgcttgatcctgataccatcgtagattcggataatacacgcatagctagactagccactagtaacgcacacaatgagaccagcggccacgctacgcaagcaaacgcggaagattcatcatcatccgtcaaaacaacttctgcacaatccaatgggcaaacaatcatgcaagtaaagcgcgatttaaagggttttgatttagtcgaccccaatgatccgaccgtcacaccacgctaccactacgatgaaattttggcccgacaactggtgattcaccacgatgatcaggtcctgttagaacaaaatttacggcaacatcgacaaccttatattgataaaatcgttagtcacgctactacagcggatccgattactgtcgcaccatttttcgttgttcattatcaagacaccgatgatacttatcacatcgaacaagattataacggcacaaccttatcgtcgctcaatccggcaatgaacgatgttacgttcactagtcaagaagcgcagtatcagcgcatcagtaatggtcaattagtcgacctagcttggtataaggagcggcctgagaaggtggttattcgttacgttcatcatagttcgagtcaaccgacctcgaataaagcatccaaaccagctaaaaaggccactgtccacacaaccaccgtaccagtgacgctacgcaccttagactttgatctgcacgaaaaaacagttgccatcgtcatgggcgacgttggtacgcgccgaacacagatcacgcaactccttgatgagcacaacgggcacaccttattgattgatgcttttaaacacagtaatagcaccaacttctattaccggcaaatcggtcaagcagacctcgtggtcatgattcagaatcagaataaacacgccacttccaaaacactgaataaagctgtcaagcattacggtattaaaatgacgattgctgatggcggcgggctgcagcagattgaacgagccgtttaccgcggaatcgctgatcttcccgcttatgagagtggcaatcccattagctacccccgcattaatgacgcttcacagtagcggccatttagcccattaaaaccacagtaaaagccccgcaataactaaaacgtttagctattgcgggactttaaacatatttcggcacaagccttaaactatgtcgttgttcagtagcagacacatcatagcctaatttcagtcaccgaacgattgtacttaaactgtttggcgctggttatcctgaatcgcaactggaataaagtcaaaggtcgcgtaatcgaataacccccgtgccgttaacttcaacgttggaatcacgggtaatgtcaaaaacgatagcgtaatgaacggatcaaagctaagtggctgctcgctaatgacctcatacgctcgtttaagtccggccaactgttcagcaactttttgatagctcgctgcagacagcaagcccccaatggcaagcggcatggtcgctagcacttgttcatcgtcaacgaccgcaattcccccgttatcttgggtaatctgggcaaccgcccgtaagattgcggcatccgacgttccgaccgcaacaatattatgagcatcatgtgccaccgtaccagcgatagctccctgtttaagtgcgaagccatgaactaagccgacgcccaccttgcccgtgttatgatggcgctcgatgacaaccattttgagaatatcacgttggcaatccgcttcaaaattctgcgttgcatcaatcgggagtgttaagtgatccgtctcgatatggttcggctgcacaccaattacatttgccaacccggtcgctagtggtaattggaagtcggctagttgtgcatggtgctgaacacgcgttgcagtaaacggcaatggttttgtcgtgcttggtaatatccactgtccccgcttcatcgtccgcgcaatcctaacgtattcgagatcatctaagaccactaaatctgccaactgcccggctgacagactgccccgatcacttaaacgatgcgccatcgcgccgttgagactagccaatgtgtaggctagttcaggacgcatcccgctctgcatagctaggcgcacgttataatcgatcgacccttctgtgagcaagtcactaatcgtcttatcatccgtacaaaaagcaaaccggctagcattcgcttcggtcactgcaccaatcgtcggcaaaacatcgcgttcaaccgtcccttcacgcaagaaaacagccataccagcccgcacacgatcctgtgcttccgccactgtcatacattcatgatcagtatccagtcccgcattgcgcatcacattgagctgatgcgcattcaaaccggcagcgtgaccatccgcatgatagccatacgcataggcatcactaattttagccagggtgtcagtatcaccacgcgcaacggccccatagtccattacttccgccagtccccgaacctccgactgttggtaaagtgggcgcaagtcagcagcatgtagcgttgccccgttatcatcaaagggaacacacggtaccgatgacggtagcataaaacagacatctagtggtgtttggcgcgcatcatcaattaggtactgaatgccagcaatacccgcaacattggcaagttcatgtggatcagtcgcaattgtcgtgacgccgtgctgtagtaagacttttcccaactcgctaggtgctaccatcgaactctccatatgcacatgtgcatcgatcatgccgggaacgatccactgaccggtcgcatcgacatgctgggccgctatgtacggctcgtcaagcaagttactaataatccggccgtgatcgatccacaaactggtggcttcaaattcacgggtataaacgtttaacacttgtgcaccagtaatcaccatttcaactgtcttcgtcatcgttattttctcctcactagtcagtctgcctacggagaaagcaaacgggtccacacggcaaattaagcagtgtagacccgtcgactcaattcgcttatagtccagtgtttacggcactgggtagaaactcgccatccatatcatggcattatataggcaattagttgtattgataaattgttccttactttaccagccttttcagttacatgcaagccctaattatcataaatgattggtacaatgaacttagaactagacatgaatattcacctaaatcaatgtcgggtctgccacaaacagcgctggcattttaaatgaacggcatacgatttgcgacaaggtcccttactggtgacgccatctaaccagaatgctgattaggatgttgttctgcgtacattgaaacgcaacatgttccgataatggcaagcccgtgaataaaaccgtcggccgttaagtcgtcttttataatgatttgcgagcagtcgcctttgatttaaagcggacccactacgattaatcaacagtcatatttttaaacattcttttgctgattataagttcatttacgtttacaataaagctaaattaatattaatatacataactattttttaggagctgatgattttgatgatgatgaataatccgaccatgctctcatacattcgtcgggaacagccagtactagagcggttgttaaccaattatcccaaacagattacggcggccttgactgccacccctgatcatccacaacactggttgatcctcgcaactggttcaagactcaacgccgccaacaccgcccgcttatacatgcaaaagacggccgccctccaagtgaccattgctgcggccgacctctacgtcacttatgaggaagctgatcccagtgtcgatgttgttatcgggatttctctaaaagatgatgatccaaccatgcaagcggcaatcgaaaaagcccacacggccagtcaagctcatgtcattatcgtgactaatcaaaaatcgactgctctgaccgcaatggccgatgcaacttgtgacttactaactggcaaagaatcagtgccctatattacactaagctttcaagccatcgtgctcactttaatgttgcttgccgtccgcagtgctgcccttcaagcacggttaaccgaattagcagtcaatcaagaattagacgagttcagttttctgattgaaagcatgaatccaactgttcaacgggcgaacgacttctaccgtaagttcactattgatttcactaacgcccctcaatttacagctatcggtgctaacgtcctagctggaacactaactgaaatgcaagccaaattcaccgaaatcctccgggtaccaacgcatggttactcattagcctcatttacccacggtggctttatggggacgcatgaagatcactgtcagttctatcttgaaatcaatacagacccggctgtcatgacccaattacaggccgtcaagacgtacgaatcgcgattaacgccccacatttataccatcagtctcactggtgaccaaccgaccgtcaatgatgatcaaaccctccagctcgaagccgttgctgatccgtataaagccccactacttgcgattatcccgttccaagtcttagcttggttcattgccaaatcacgcgggatcaatttgaaccatcccatgtacgcagattttcaagcggctactaaactcaagtaaagattactaaatcaacgcaaaatgaccagtatcgatattcttcgatactggtcattttaattaatgctcgttttccgtaactgcgtaataccgaattctcttatgttgacgctgcgcatagccaatttcttgcctagtccgctcaccaatgtagccagcaacattaatgaccactacttcatctgccaagtcgatttttttcaaatgtgtctggcgtaaattctgaagttcaattggtgttaatacttcatcactgaaaactggctttaaaacaataacaccttgtttactcagagccagttcaaccgtttcaaatactgccgcatattttctagacccacataaagtaactattttaacagtcattcgtcaaccttccctaaagtgaactgatcgaccaacgattaaacctccgttgcagtcacatgcttagttttcactgcagttcgctgattcaagtgcgccataccaacaccagtgaaaccgctgattaccgagataactggacaaagtaaactgaagaaaacaaatggtaagtattggacggttggtactcccagcgtcgtcgtcaggaagacgccgccaacgccccacgggactaggtaattgatcaccgtaccgccatcttcaaggacccgtcccagtgcatttccggataagccaccatcattgaatgcctggcgaaaagcgcgccctggtaagataatcgaaagaaattgttcaccaacaaacacgttgacaccaatacaagttaatacaaccgccaatactaacttgccatcgctattcaagtgcttagcaaccggggtcataatttgattgatcagtccaaacttgaccaacaatcctcctaaggatagcgtaaccacaattaacgcgaccatgctcatcatgctgacgattccgccccgtgaaagcaacgtatcaacactcgtatttcccgtcttcgaaacaaatcccgtgttaataatggcggttaacttcgccagtgataactcaggctgttcaaatagaatcaagcccgccgaaataaaaatatttaaaagcatcgttggaatggctggcattttaaacccggcacaaatgaagactaagacgattggtaataatgccaaggctgagatactgaaatgaccatttaaaaccgcaactgtttgattgatcttggctaagcttgtctccgtattactgtgccccagcatagcaaacaagcctaatgaaatgagcccggccggtagcgtgctccataaaatatgtttaatgtgcgtaaaaagatcagtatccactacggctgaagctaaattattggtttctgataatggtgataatttatcgccgaagattccaccactgataattgcaccggcaactaaggctggattcagattcatggtcacgcccatgccgaaaaaggcaattccgaccgtcgatgttaccgtaaaggcactgccgaccgccgcaccgactagggtacaaacaataaagactgatggcaaaaaccactgaatattaataattttgaatccaatcaccatgagcgtaggaatcgttcccgccgcaatccaagttgaaatcatcgcaccaatgagaataaagatgaagattggcacgatccctttatcaatgccctctttaatcccagcattaactgctgaccatggaaaaccgcgcaacatcgcccaagcagtgacaacgcccattgcgagtaatacgggaacttggggcgataatccccaaccaatcacacccgcactcataattccgaggacgaccagtaagacaatgactgcttctaaggtactaatttgtggtgcttttgttttgttcataatttattaccccttcgattgataaaattccagtgacgcatattcatcatcaaaattttaatatcgtgcaatcccaccacagcgttgatttgtcattattctcatcctcttcatcaaaaaaatcgtccccattgttcatatgaacaacagggacgattagactagtcgcggtaccacccaggttgcggattattgacacttaatccaccactcactagaagataacggttctagttattatccgttcagtcgaaactcggttaccgtatttcaatcatagtagctgaccggttcgcagcaaccaccggcttcctgacacctaccactatgtctacttgatgtaacgttatcgtacagttattaacttgtgattaacaataccaccatcttttatcatcgtcaagccattttataatataattctcattttaagattacgaccgtgttacagctcgcaagcgcgcttggtgggcaaaagtgatgccaccaaatagtaacgtccaaataatcgcaccgattgcaccgacaatatcagcttgaatgaagaatagactggcaaaaatgagaacaaaaaaggcaatcgtcagtgggctcgtgattcggtacgccggcatcttaaacccatccgccagatagtcattagatagccggtacttccggtgggccagcatcgccagcgtgtaaacaatcaggtacatatcactagagatcccggtcacgacggtaaaaactgccgtcgttgcagcacttaaactcatgatgggggtcactagcactagtaccgcggacaacacgattgctgctgccggcacaccacttttcgaaatctgaccaaagatttggtgcatgcgactcgtaactggcatttcagtggctagctgatagaagtgacgtccagctgagaacaaacaactatttagcgatgaggctgccgacgttaagacgacaaagttaatgatggcggccgctgctgggtatcctgccaacttgaagacttgcacaaacggactgctatcgggtgacagtgatgtccacggaataatgcccataatgacaattaacgcaccaatataaaacaacaagatccgcaacaaagtttcattgaccgcctttttgataacgcggtgagggttcttggcctcaccaatcgttatactgacaaattcaatgccctgaaaagcaaagaagaccattggaaatgccgagataaagttagctatcccattgggaaagacctgataattatggaacaaattgccgattgaagcctggcctaatggggttgggtgatgtcccaccatcatgaaaataccagtgacaatcagtgcaatgattgcgacgatcttaatcatcgcaaaccagaactctgcttcgccaaataaccgtgcagccgttaaattaacgcccgccaaaattaacaggaagctaatctcaattagccaggcggggacatttggtaaccaaaatttgacatacgttgccgtagccgtcagctcagccatacagacaaaaatcaaaccgatccaataggtccaccctgtaaaatgaccaacactcggtcccaaatagcgggaaataaacgccacgaatgtgtgttgggtaggatcagaatagaacatctcaccaattgcccgcatcattaaaaaaaagaagaagcccaacaccaagtacacccacatgactgacggtcccgtctttgaaatcgtactccctgaaccaagaaataatcctgtcccaatcgtgccaccaattgcaatcatttggacatgccggttactaagcgcccggattgtgccatcagcattagttattttcataaaacccctccacaaattttaatgactttgttgctaaaatttaatgttgtgtcattatagcacgctctagctttcacttaattgcgatttttaactgttaacccctgtttttaacgacgaataggtcgcaatactttgttttctaaagctgtcttccttattgaaaacgtcaccaaaactgtagttgctgcgtttgaccgcctaatttggcgctacgaaaaaagccgcccgagtatttacccgaacgacctcatttatttaatgcacccatcctgacacaataacacttaccacaaaaaggcaatcatcttgtaagcgacacccacaaaaccatcattgttataccccgtgtttgtatctccatagacattgagtagtttcacgttgtctggaaaattgtggcgatacttgagcatttctgaaaaatgcttcgtgaaacgacttggtttaacatccaagcgccggaccgttgcttccgtctgcgtgctcagaaacccggtcaggccatcgaacggtccgccaatcgtcacgattttattcaacgttggtaagcgtttgtcatgcccatacttcaatgcctgattgacaatatcattggccccgagggaatgaccaaccgcattataagctttgacgccatacttcgcttttagttggactaagacttggtgtaaccaataaatctgggctttttgtgaggcgtgattatcttgaaaaacaacttgaaccatcggattcttgattgacttttgccaataacccttaaaggccatcacaccattcttgtacacgtgcaccactaacgctttttgggcagcccccgctttttcggctttacgaatcagatagttcgtcgaatacgccccaccattgtagccatgtaaaaagaccgtcgctgtctttgactggtcatattgattctttaatattcgtgcagaacgcggtgtcaattgactcgttactttcgtaatcttgttatcatgattccgggccccaactaaaatcacagccgcaccgataacaaaaacaatcaataacaattgaatcaccgttcgccaacgtttcatcaaaattatcttacccttcattatgtttaacagtcttattttacgcgtttcaattaaaataaccagtcatcgttttcaacaatcgcctttttaacccgcaccaacgaatattgaacccaaatcatattctttagccactcatctcgttataatggacttactaggttaaataactaacctactcaaattgtttatttctggagggtaactatggaaaaaccaacgtttaaatatcctgataaggctgcgtatgagttcgtcattcaagccttagccgcaaaagggattacttatcatgaaattgcgcatatcacttataacttacaaacaaaatacgtccctaacttaacgatcgaagagtgcgaaatggagacgcaagaagtactgcacaagcgcgaactattgaacaatgcgatggttgcgttagaactcgaccgccttgccacagaaggccagctaaacgagccgctccaatctatcattgccagtgacgccggcgtcttcggtgttgatgaaggcttagcacttaatatggcgaatatttacggcaccatcggcgtcactaattatggttacgtggataaagttaaagaaggcgtcattaagaagttagatactgataagtcaggcgttgttaacacgtttattgatgacctagttggtgcgatcgcggcggccgttgcggctaaaattgcacataagtatgcctaagcattgtatttgctagtcgttatcgcttataaaaatcagcaggcatcctacttcaatgcctgtttgcttgaattagctagtctgtactggatatgtccgctaaaaaacagttacctcaaaatgaggtaactgtttttttgttgaccatgctcaccactgaattaacccacaactgtcaaatgacatgtctactcctcgacctaactactgtaactgatccgcataatctcgtaagtaagttgtcatcgtatgcggagcgtgacccagcactttttcagccgtatcggtcacgcgtttagcgttgcccaactgggtaatcaaatacagcattaccataacattaacatagtccttcttgattccccgcttcaacatcacgcggcgaaaccgccataagctcggtcgatgatacgttaccgggtgaccaaaggattcagtcattagcgccgcaatttgctgataagtcaacgcttctggaccagtcacagtcaatttctgttgtaaatattgtgtatctagtaacgccacgcccgcaatctcaccaatatcacgtgtatcaataaaactcgtcttcgaccgcccggctgggataaacaaatcgtgattttgctgaatgtcgacgcgatgcgtggtattcaaattttgcataaagaagctcggtcgaatgaatgtgtacggtaactgtaactgttcgatcatctgctcgatttgatgatgtggcgtcattggattatgctcaacacccatcaacgaaacaaatacgacctgctcaatgtggtgtgcttgtaagcattttaggaagggccacatatcttgcttgggtttagcaagttgtggtggccgcacgaaaaaaaccttttggattccccgtaacgccgcatcaaaggtcgtctcgtctaaaaaatcaaaacgtcgaatttcgacgttcggatacgcagccaatagttgctcgtctttatgtaagttgtgggcaccggcaacaacttgcacccccacctgttgatctagatattgaattaacggtaagccaatatttcccgtcccacctatcaccagtattttcattttattaattgctccctagtttttttaacagttgtcttaaagactgtttttcagcagccgtcaatttctgaagccccgtcgcaacgacctgatcgctaatacgctggccggcctgcaattcttgtatgccaacttgggtcaagcgtagtagctttgctcgctggtccgctggattaacttcctgttcaaccaattgcttggcagctaagcgtcgaagaattcctgacatcgtcggccggtccatatcgagaacgtggcacagctggttggcagtcggctgttgcgccgttctttcgacccaaagactgatttgttgcatcacagcccattgttgaatcgtcaatccgttagcaattagccgttgatttagctgataacgtaactgtttggaaaactgcattagtaaataaccaatattatccattttaccctccactatttagttagtatactaactaaatggctgtaatttgtcaatttacacacaaaacagcaccgcttaactgcgccaatcagtttatactggcaagtaagtagtactgttttataatgtttcgccccaaaaacacggcatcaactcataagccgatcattttaagccatctgatgttctgacattgcttgcatcttgagtacgcgctgttcacgtggaataaacatccgaatctcatcttggttaaagccgcacagaagtcggtgatcgtcaaaaataattggccgccgcaataattgcggtgtttggcttaatacccgaacagcttcgcttaatggcatatcttcaatcggtgtcgtcttactcagttggtgataagcattggacttagtactgatcaaatcatcaatgccattgtacgtgtactgtagcaggtgcttgatttcagtctccgttaacggctgtgcattcatattacgttcatgaaacgggatccggtgttcgagtaaccaccggtgggccttgcgacaacttgcggtacttggtaacacacataagtttatcataaaattatccccaatcttgcttgcctaacaatgcagcccccattattgtgcactataatagttgacgtcattaattaacaacataatcatagcaaaattcgcagctaattgctagcgttttcaaaaaataattaaaataatttgataggcgcagtttattgcaggcctaatcccaatttcatctataccaatattacgcaatttatattaagcggttggtaattgaccactatccttcaggtaatcacgcagtaccactgcctgattatgttgttcgtccttggcaccgaacaataagatcacattcgtcttcgtcagttgttcagcaacttgactaataaagctggccgtcaggggattctcatccaattcagcccggtaacgatcgacaaattcgggatatttcgccggttcatgattgaaccacttacgtaacgtggtcgacgggccaatttcctttacccaattgtccaactgagcgttaaccttcgaaataccccggggccacaagcgatctaccaacacccgataaccatccgtatcaactggtttcgtgtaaatccgttctaattttaattgcataatgaacactcctcctatcgtacgatgcggtaaacaatctatgaccatttacaataacctatcacatttcatgaccataagttgactccattataacgcaggtgccggtatcgttaaatcgaaccaacactttcaaccacatattgatcagtcctcgtgacagccactatcatcaattcagcacaaaaaaatcaggttccacgaatggccctgattttcatcacaatgagttgactaacatcttatcatgattatgacaatcacgttagccttcaccgatcacaacttcaacttggccccttttcggcacaaaattaatgttataaatcggttcccgcaataccttttcatattcttctaagacatcttgtggcaatggcgtatgggcggccaatgcgcgcattaagtcatcgaccgaataaacatcttccatgttaataaagatccgcatatttcccacaacatcattcaataattctgtcaaaatcgcattgggcttaccgttaccatctgtaacaaccacttgattactgtcgacttctttatggtctatctttgttaacttaacgatatcaaatacatttaacatgcgcgaccctccgtcacaatattgatttgctatattctaccacaaccatagcacatctgaagggtgaaaagtatttaatgttgactgaattaatcaattgaatagcgtgcaaaaattttttcttgaaccttaggcattggaagtttctgccgctcaatcaacgtaaaggtctgaccagcaaagtaggctaagtcacttaacccaacttgaccactcaaaccttgaatggtccacttctgatgcgtaaacgtatgggtcacaggccgcccggtcagataatgggccgttagctggagctgatattcacgtttaaaataattttctaccgccgtaactagttcttcaggttggtaatcatcatctaagtctaaatctgcaatcggaatcaggggaaccgtccataaattagccaacatcccgttactcggtcgcttcgtcatcaaccactgatcctgcatcttagctaataccgccacgtaagcaaccggcttgggccgcggtttcttcgtcttgaccggataggctaactcatccccatccaaataagcttgattaaagcgtttgaccggcgaatgagccgtatctggttgccgcgctgtcatgtagcttgaaccgaggtccataatcgcctggttaaaatctccaggtcgctcttgtgaaataatctgactgattacccgttcaaaaacagcgcgggtctggggcttcgcaatatccgcatcaatcttgagcaaccggctaaagacgcgataggcattaccatccacagctggaactggttcattgaacgcaatgctggcaatcgctcctgcagtgtacgggccaatcccaatcaactccgtcagctcagcggcagtttgaggccactgtccatcgtaatcggttaacaattgtttggcacaccgttgcatattgcggacacgtgaataataacccaggccctcccacgcctttaacaactgtgactcaggtgcggcagctaggtccgctaccgttggaaaaagtgccataaagcgctgataataaggaatcacagtttgaacctgcgtctgctgtaacataatttcagagacccagacgtggtaaggctcatggtcatgtcgccatggtaaatcgcggccttcgtgatcaaaccaatctaatagcgtcgtctgaaaatctttaattgttgccgcatcccattcaatcattactaaccctccaaaaaaggccacgaggcttcgtctatccgaagttcgtgaccaccttatttacaaattaatccaaagtgttagccaaatctacgagtgttttttcgtagtgatccgtcacactttcatcctggaaatcggcattgaaaacggccaatgtcaaatactcggggtattttaagatgaccgctgccagccgcttattaatatctggatatttttgatcttcattattcaaaatatccagactcgcttggtaacaaacattggctaaaaacaaataatccacaaaataattaaatcctggttcgtttttcaattcaaaatgcgccttcacgtccactgtttccgaaatattcgttaaatacttcgttacaatttcttgatactgacgtaacaactccgcctttgcttctgcatgtaccgttgccataaaatatccccacctaatttaatctctgtgaagattatagcatacggcgtaacccctgctgaatgttagctgctaatccagctaactgatcgtactgccactgacgctcggcagtgaccgcaaccatgtcatttggttgcgttaaattaaccaatttaattgcttggtccgaggcccgcagcgcattttcatccgcatctgcggaagctacggcccagcgaacgcagtccagtgccgccgcaccaatggaactcgtcgtcgttgcacttaacttagtcaatcgtgccagtgcctgccgtacctggtagccactaacaagattaacttgccacaattcattagcatcaattgcgagtcgcaattgtcgatcatatttctgttggttatcaacatactgcaaggctttcttggcgataattaacgcccatttagccaattgttgttgtgagagttcaccagtcaaagcttcgatttgagcccgtattccagggtcatcgtcaatctcaatcttagggtgactcggtctaaaaccttccgtcatcacgcattcctactttcttacaaatccgacaacaaacatatcctatcattatcaatattcagttcaattgatatatcgataggattaaattgtaccagaaatccagcaaagatgtgagtatctgactccagatttcatcaaaaatttacaaatttttgtaaccgtttcatccgctataaatacaataaaaagacgccctaccaccaatcgcggcaagtcgtcatataaaccattactgaatttcaatatgatgggtatccgcagctgccttctttggcaaagttaactgcaacacaccattttcatatcgtgcttcgatcttgtcaacatcaacgtcgggtaaagaatattgccggccaaagcgaccagtttgacgttcactcgcgataatattaccatctttatcgctttcatcactaatactatcgcgttttacagcaatcgataatgtgccatcccgatacttcaaggcaatattctgtttatcgattccaggaatatcgactttcatcgtgtactgatcgtcattttctttaatatcagtctttaggaccgacccatgactaccagcatttaagaatgtccgaccgaatccattaaccaaatcgtccatcttagtccagtcattcaaccgatcaaataaatcattgtgccaattcatcatatcgttagccattatgaaatcaccctttcaatttgtttacatcattaataataagcactttcatcaagattgcaacaatttagcactctccgtatcagagtgctaaatcactccacttgatatgcccgcatatcaactgggatcaccctgaccattttatgtggcgtgattgttagttgctgggtcgtcatcttcgtaggccagcgagactgcgggcgatcagctaattccaaaccgaccaacattctgattcgatccagaatatcaggcaccccaaatacattattaccctgattaaatgaagtttggagcatattaatggcaacctgtaagcgctgattatggaagctaaaggttactggcacgtacaccagatcagtagacgataattgctcttgtgccaacgtcttatcaagctgcgccataaacgctgtaaattgatccatttgcgtcacccccatcattaattaccgctattatactgcaagactgatgtgacagctattcaaatggatggctgtcatagcattgctaacaaccgaccatcagtctccgtgccaactgcaattttgctcgaaccagtcaatcatcaccaggcgatcccgtgcactcattttggacaaaataaaagggcgcgaccaatgtctcgccctaactgaagaatcacgctaattattagttattagataactttttagcatcttcatcgatcgtttcgaaaccggaaacgccactcttcttctttggatgctttgcacgttcttcttcggctttttgaatcatagcctttttttgttccttgctaagcttttgtgccatgattatcgcctcttttatcttggacagcgaagtacaacttcgctacatgttcattataagtctaaattcaaaaagtggcacaaatttgcttaacttttttgaaactgcttacttgaattctgtaataattaagtttacagttaagatgttcaggaggggattatatgacaaatgtattgatcttaggggctgcgggccaaattgctcgtttagccgaacagcaatttttagccaacacaactgataatttgacactttacttacgtaatagtagccgggtcgcagaccaacaatctgaccgggtgacgattatcgatggtgacacgactgatgaagccaaattaacccaggcgatgacgggacaagatgtcgtttatgctaatttggctggtcaaaacatcaaacagcaggctgaaacagtgttaaaagccatgcataccagcggcctcaaacggctcatttggatctcaactttagggatctatgacgaagttcccggcaagttcggtcaatggaacaacgcaacgttgggtagttacctgacgcgctactacgccgcggctgaagtcctagaaaattccgatctcgactacacaatcattcgccctgcgtggttgactaataaggacgaaatcgactacgaaataacccagcgacacgatccgtttaagggaactgaagtttctcgtaagagcattgcggcactcgtcgttaaattaacccaagatcccacaagtaacattcgcacgtctttaggtgttaacaaacctaataccgatggtgacaaacctgcttggtattaattaattaccaggccgtcaaaaaaacaatttaaagatcaaccagaatcaccacaataggcaatgcgtggtggttcttttattatccatcaaattatgagaaaaatgataatatctagacagttaactaacgatgactgataatcaagctatcaattcactggtacaaccagcaatccgttctcatgtttttttcatcaaaagcaatacctgtaaccattgataaatcgcgggtctttgcaattgacggtcaaaaatacaagtgttaaattatagactcaatttgaaaataactggcgatattcttcagttttcaaggaggctttcacttgaatttgaaatggtacgttaagcaatttaatggtctaaccaccacccaactgcacgatatttatcaacttcgtgccaagacctttattaaagaacaagatcggtcttaccaagaccctgatgatactgacttggacgcgcgtcacgtcttcgcctacgatcaggggcaactcgtcgcttatgcacgaatttacgaacatgctggggtcgtttcgttcggccggataacgactgacagttgctatcgtgggacgggccttggcaagcaactcatgaatcacgtcatggcaattcttaaagtgcattacagcgccgccaccattgaaatcgatgcccaaacgcacgcccagaagttttacgagaagttcggattgattgcggaaggtcagccttatattgacctgggtgccgaagttattaaaatgcacgcccccgcccggaaactggtgttggcgtagcacaacttaccaaccatcgtccccaagataactttaatctactcaaattatgattaaagctgcgcatcagaatgttaaaattctgacacgcagcttttatttttggtcatttcacaaatggtcaagtcctgctgagcccttattcaagggccctaactaaacaaaaatgataactatcattacaactaatcactagccggatcactccgatactgctgcaagatataaatcgcgacaatcaccaataacgagccgaggatttcgacccatgtcacttgtaagcccaagaaaataatacttagtacaaaagtcactactggttggacggcatcgacaatactgaccaccgcagacggcgcgtactgtagactatgtagcaacgataagaaagcaaaaatcgtcccgattaaaacgatggcgccaattgaagtcactagcgttggtgtaatttttggtgcaccgatccaaattgggtgatataaattaaataggattcccgcaatcaatgtcccccaaccaagaatcacgaccggtgaactttcggctacaatctttcgcggcaagactacgtacaaggccgctgttacccccgaaaggattccccagacgagtgcatccatcggaatcgccaactcatgaatgttacccttagtgattgctaaaaacacccccaacaaggagaccgcaaacgcaattaaatcagttcgtaaaggcagttcccgtttaaacagcaacgttcctagtacaataaacaaaggacttaagtattgtaaaatagtggcggcagcggctgttccgcgctcaatactgatgtaaaaagtatacatattcgccatcaatcccactgtcgcgtatgccactaattgtccaaccgacgcccaagatctaaagactttgaagattttggtaccctgttgcacaaatccaatcgctaacagaatgattccagcagataacgtccttacagataagaaccaatcagccgggatggcttggttttgtgatacgaactgcatcactgtacctgagactccccacagggtcgaggccaacatcgcccacatgatgcccttcatataacggttagttgtcatatttttcaatttcgctctacctcaatttaattaatggcaatattataccgagacttaattaaaactcactgaaaatcgagcattgttttttaggaagattcagtaatctttatcataatcaagttctatcatctataagcaacgataaatccgaacttttattactaattgtgcgcaattacacggaaaccgacctcaactaaatagcactggggcaggtaactacagtaattgcccgccccagtgctatttaagttcgtaccgatcctaacaatttgtgcccatactgatgccgtttccagcacaccgtacttcaagtgccgtttggttagctattgtttcactgttgacaatccctagtccgaactgaccaaggcagaagtacttaaaagagcgtcccaacgtagtagtgaatgaacatcgtcacgatcccaacgagcacgttgcgaatcaccgccgtcttcacattgcccttacctaatacggccgataaatatcctgttaaggccacggcaacggacaccgcgataattgttgccggccactgccaatgagccggtgcaaacgtcatcgcgagcaacgggaagacgcctcctgctgacgctgagaatagcgatgcaaacgctgcatcccaaggattcatatagtgtcctagttgcatatcatatttgatgctgacaacggttgccaatggttttttagttaataaatcgcgtgcaatcgccatcgccgtctcttccgtcacgccaagagtcatatagtggcgttgaacagcatgcaattcaccctcaaaatccgtcttcagcaattgccgctccttttcaaccacggctttttcagtatccttctgcgtgctgaccgaagcatattctcctgacgccatcgaaaaagcacaggctaataaatcagataatccagcaataaaaatcgtgaactgattagtcgtggcggccgccacactaaacagcacccccacaacggttaaaataccatcattagaacctaagacacctgctcgtaatgagtttaacttctcatccatcgtttgtttggtcttctcagactttgtccttgtcagttgcataagctcgctccccttgaccctttaattaagcaaataagtgaccaataaagtacgttacgatcatcgtcaataacccggcaacgacgttacgaaccattccacgccgacgattagcattacccagcatcgccgcaacgtatcccgtaatcattaatgcaattccgacagccaacaccgttgctaacaccttcacccgtggtgggaaaaaggtgatcgaaactaatggcaaaattgagccagtgggaaaggcaatcatcgacgcaataccagccgcatacggactgatgaactggttcggattgaaaccatagcgctcacgcaccgtcgtagtcagcgcatcttccgccatcatttcccgggttgcttgttgcgccaacggtttactgattccttgatcgacatatttttgtacgactagcgacgcttctgcttcataatcatcggcaagtgctgccttctgcttagtaatcgccattttttgtgaatctttttgcgtattcacggagacgtattcacccatggccattgaaatcgtcccagccaacatcccggctagtccagatattaaaatcgaaaaactattggtggttgcccccgcaacgccaacaacaatgccggcaactgatagaattccatcattcgctcccatgacacttgctcgcaaaatattaacccgctgtgccaaagacatcctttttttcatgtttgccgcctccgtagatactttataatcattattacctagtaaatattatatctttcagaaagaaaatgcaaggcttatttgtaatcattatcgagtataagttatgtattcctaaactataatatagtgtaccaccatttaattattaaagttaatttgaataattattataggtcattgaaagtgctattctgcctagaatcaaaaaaagcagcaccgctagcataaaatgctaacggtgctgctttcatattttgaccctaatatattccaacttagtttgctaaccggaactgttgggttgtctttaattcaaattcagtcggttgcgcggccgtcattaaagctggtgtcaattcgacccgcgtaatcgtctgatccgcgtatggttgcatgtaaaatgctggttcattcatgctcatataggcgcggtactgggtataatctggcgtcccgttatcttgcatcttaacgcccttaggaatctccactgagttcagcatgtgtgataatgcgttgacagcttctgcatcagtcgttactgcatccgtatgttcacgcatgaagaccgtccgaacgaagcgtgcaactgacgtatagtcaccaggcattcccaacgccccagttccaggaccgaaaggattcaccgtcatgtcaccgtattgacgactaggatgagggccgggttgtaagttgacgtaagtactcaaattcttgagatgccattcaaaatctggtgtgttcgtcatgacgcccaccggattcttcatgtagtgaacaccgtcattttccaattctaagacgtaagtagaaccactcttgtcactaatgatccagtgtagtggtaccacaatattcaatagtggtgcggcggcttccatcacgttcaagtcagcaatccgttcgcctaattcagcggtgctcttcacgtttcctaaaatccacattaaaacttcgtggggtgccaagttaaccttgccagccttagtctgctgagtaaagtgagcttgtcccgagaaatagagtgcagcagcactgaccccgtgctcattgacaccatcgacaaagatatagccatttaagtcacggcccgttccaacaaagctatacgggctatcaaaaccgtccgcattggtaacactgtcaaaatgtgattccgtgggattgccactggtcgaccaccaagttcaaaagcaaagtccatggtgcgtgctaaaaactgatcacccgccgtggtttgaatcgttaaactagtacacatgggtttcacatccttgatttaaatactattattctagcatctaaacccattataaacacacatttgcacaaattaatttacgccaatcagtttaccttagtcttttaatcgtaacgtcatcgcattaattgccacgattaccgtgcttaatgacatcactaccgcaccaaacatcgggttcaaaataaagccgagtggtgcgagaataccagcagccaaggggattgtgatgacattgtatccagcaccccaccataaattttgcgccatcttccgggtcgttcgccgggccagagccaagaaatcgaccacatcatttggattactcttaacgagaacgatatcagcagaatcaatagcaacgtcagtcccagacccaatggcaacgccaatatctgcccgggccagactaggggcatcgttaacaccatcgccaatcatcataacgtggctaccatcagcctgatactgttgaacgagcttagccttatcttcaggcaataaacccgcatgcacttctgtaattccgagctgcttagcaacgacttgggcgctctgcggattatcaccggttagcattactggggtaatgttttgggccttcaaactatcaatcaagttcttggcttccggcttgatctggtcaccctgagcgacaaaacctaagactgtctgctcctgaatcaaaaaactgactgagttaccggcacttgccagtcgattgaacgtttgctggtcataggctaaattttgtttatccaagtaagctgccgaaacgatctgatacgtctgcccatcaatcgtgccgcttaacccgacaccagtaatctgatgaacatcctgactaaccttaggggttaactgatgttccttagcggcagcaagaattccgacagctaagggatgactagagccattttccaaaccggccatcatcgccaagactgcgtccgcagttagccggtcggcgctactttgataatcagcgaccttaaagttaccagctgtcaatgtcccggtcttatccatcaacgcgtagttcaactttttgacttgttccatcgcatcccgattacgaatcagtaacccgtggctggccgcaatcgccgtactccgtgccactaccaatggaattgccaatcctaaagcgtgaggacaagcaatcacgagcactgtcaccgcaattgatagtgctaacgccagattgcccacgagtaaccagacgataaaggcaacgattgcaacggtcaaggcagcgtagaacaagagtccggccactttatccgccatattttcttgcgacgatttggccgcctgtgcgtcactgactaacttcatgacttgggctaagtatccggattcaccagtcccggtgactttcatctcaaacgtcccatcaccattgactgaaccacccacaacttgatccttagcgcgtttttcaactaacttagcttcaccagtaaccatcgcttcattcacactagtcgcaccatttaacactgtgccgtcagctggaatttgttcaccagcccggacctgaacttgatcaccattagccagatcagcaattgccacgtcatggacctgcccatcaactaacttatgtgccgtacttggtaacagttttgctagtttatctaccgccgatcccgcattcatgaccgtattcatctcgatccagtggcctaacaacatgatgacgatcaaagtcgctagttcccagaagaaatcggtcaccattggttttgcatttaacaagtcattggcaaccacagcatagatactgtaaacgtacgccacactgatacccattgtaatcaacgtcatcatggcaggcttatgatttttgacctccgccttggcaccgctgaaaaacggttgcccaccgtatagaaacaggatcgtgcctaaaattgcgacgatataatcggaccatggtcgaaaaacgatttgaaatggtaaattgacccccatcatcggactcataatgataatcggaatcgtcagaactaacgctacccaaaacttcaacttgagattgcccatgtgcatcatctcacctttacccatatccatatcgcccatgtcatttgaatcatggtgcgccatgtgttgcatatccatgtctttcataatagcgacctcccctagtcggattgtctacatctgtaatttatagctaaagtttacaattgtagacgataaaagtcaagaaaaacactttcttgactttttgtcgccattcatatgttttctgagtatcctatcttgaaagtaagtcccttccattaggcgcactataactgatggttccgattaagacctgcacgaatgccccatgttcagttagccaagtatctttaagatcatttccctcaaaaaatgtcatgttcagattaagagaatccaaacatgacattcagtgttatttcaatattcgtttataaccacattaacaccgcgtccccggcacacaatcgcagtccaccatttctggcgcatccttggctttttcagccaatactgcctgtaaagcggcgatatccgtttgactcaattccgtttggttaacaaggtccaccaacgtttgaccaacgcgcatctgacataaatgaccgaagagggtgcccacggcctcatccatcgatggctgttcctcaaccattggataataattgaacgctcgaccattcttttcagcacgtaacgcaccttttttgacgagccgtccaagcagtgtcttgaccgttgctgtcttccatcccatcttatccgccatgatctcagcgacctgactactcgtgacattgcccaacgtccaagcaacccgcatgacttcccattcggcatcactgatttcaattttagtttgtgcttccaatggtttgaccacccttcgaattaaattaactgtagtttacaaccgtaaacgtaaaaaagcaactatcactctcgcatggttcaccatctagcatagcgcaattttctttctaataacaacattgactgccattaaccactacccaaatcatcactagttaggttaataacttgattggcgcaaaaaaacggccctaattactgagccgcaacaaaatgatctaataatgatgataacgccgcgacgctatctggataattgctcggatgttgtaataggtaactcttgattttgccgtgatacaataccgtcgtggcggcctgtccgctcgtctgcaataaactccgccgaaattcattgagcaacagttgtaacccgctttgcgctgcgtcttggcgctccaacatcagtgccgcacggctgatagcatcgagaacctgcgtttgcgtgatttgtgattgtgttgacatgtttttccctctatttactgtaatatgcttaagtatacaccgttagtggcacaaacaggtattatttatctgttgaaaaactatgttatgctactaaatattaattattttagtgacgggggttcagcatttgaaaccaaactcaaaactattacagcgactacgatcatggatgcgtgggcggtacggtcaaaacgatacgttaaaccgctttttaaacaatctcgctttactattgatcgtcatcagttttttcattcgcaccgggtggctactcttaattgccgtgatgctcatcggtattagttactggcgtttgttctctaaaaagatttatcagcaagttgcgatcaatcgcggctttcagcgcttttggtcaccgattattcgcccattcagccgtttaaaataccaggtcaagcagcattggcaataccgctttttccgctgttcacagtgtcaccaacggattcggattccgcgtcatcatggtcgcgttcggataacttgcccccaatgtggacaccaattcgaagctaaagtgtaaccatcgtgcttggatgaaaacataacgattgttgaacataactgatccgcctgcagacctgattttgcttagcaaccacctataataggccaccttagtttgacactgaggtggcctatttacatacaaaaacactattttaacaaccattacgtgctacctttctcgctcaatgaaactgccgacaattgcagtcacagacgcactagttgagtgatggttttcaaactaccgtaaatcaatcctcttttttcagaaaaaacacttacgaaaaaaataattttctggtatgctaacccattgtattcaggaaagtgagtgtgaacaatataatggattcagtacaaagtagcccgcaagctaaacaacgggcccgcgttcccgttgcccatcccatgctagccatgatggggatgttaattggtggttttgttgggatgtttagtgaaacatcactgaacattgccctcccccaattgatggctcagctacacgtgtcaacggcaactgtgcagtggctagtaaccggttacatgcttatgattgggattgtccttccactttcaagcttaattaccaaatggtttacgaccgccaagtgattttatttgccctgattgacttcgccgttggtgcgattatttcggcttcagcgcctggctttggcgtgttattattcggtcgaatgattcaaggtatcgcaactggcctgatcttaccactcatgtttaccgtggctatgcagatttttccaccctacaaattaggggcagctatggggatggtcggtttagtcatcatgttcgcaccggccgtgggtccaacgattgctggagccatcttaggactagcttcatggcggtggattttttggctctttatcccattcttgattattgcctttatctttgccgtcacttcacttaaaaacattgcgaaagtaacccggccgaaagtggacttcttatccattttactttcaatggttggctttggtagccttgttgttggcgttagtcttgctagtgatcaaggttgggggtcgcccgctgtactaggtgccttaattttgggactggttattctggcttggtatgcccatcgacaactcaccatggaatcgccaattctgaaccttaagacatttgctatccctggttttcgggttggcgcttgcctcgttatgattaactttgggattatcttatcagccatgtatttactcccaatgtacattcaaaaggggctgttgattcccgtttccttgactggggtcatcatgttacccggtggcttgatgaacgcaattgtatcggccgtctcgggtcgcttatatgactcgattggcgcccgcactccagcaatgctggggttcttgatttcaatggttggtgccctcatgttggcactgacaaccacgcagagtgcaacgtggtacgttattttggcccacgttatcttaatgattggggcgccattagcgatgtccccttcacagacgcatggtttaaattccttaacgggaccaattgccgccgatggtagtacaatcatgaacacactacagcaagtcgttggtgccatttcaaccgcaattgcaacgagcttattaggcattggccaagcttcttactacgccaatgggggtcatcaagctgctagcgcgttcgtcaacggtgcccattacgggttctactttacgtttattttagcgctcgccggtttgttgcttgcaacccgtttgtctaaaaaaacgactaactaactgtcattaatcaaaactagcgctgttaatcataagcagcctagtttttttattttacgatcgattatcattgaagtagtcttgggtggcttctcatcagcaagccacccaagactactcagtcaccatgcaatgcttagcgttcttaccacactaagaatcctgataaataattgcactttatcgcattttaatgcacaattaaaatgataatatgaggagtcgaaagtaatttatggaattgacaattggtttaattattggcaccagcatcattcttgtcatactgtgtggcatactcagtatttactactatcaccacaccaaaaagctgaacggtacgatctgggcactcattggtattgcgctattgtgcctggctggcttttttgtttgggtcgtctggtttgggttataaactaaactgcggctcaccgttactagtaaccaatcccaggaggaattgctcatgaacccagaagacatgtttcaacgttatctcaacaaatatcagatcacgtatcaacatcctgaacatggtctagttatgctgacctcccctgtctggccccaacatcccgagctccagcaggccattcaaagcgcttttcaaggcctaaacggcgtcactagtattacaatcaatagtcccgaacaattagtcatgcgctatcactctgatcagttacggcggctaagtccgctgactttacttagcttagaacgccagttaagcaagcaatatcatcaagctggctattaaacttaatggaacgcaaaaatgcaggctacccggttaaaagtggttagtctgcatttttgcactttattattgatttagaatgttacagctgccatgattttaccttcatcgccgctaaaatcgacgatgtggcgttttaagttagcagtccaagcttgacacccagccttggcaaactgcttgacagcgtctgctagagccagctggccagcaatatattgcttcgcgatttgttcaactgccgcggcatcttcttcacgagcgacccggactgctaagccattcgtccgccgttccacgagataaccgttctcaccaaagtaagttgtggcaccagtagcaacatcatattgaaaatgttgaacgcccaaatcggcttcttttttggcaatcgtggcaaagtctgcgtggtcacctaaattatttaatacgtcatcgatctcagttaatttaaacatcatgacacccctcgttctaatttcgtttacttatctattgtaatccaattagacacgtttggcaggtaacgggtagaaaattcgcattaaagccacgtaaatgaccccgataagcgccatgtcaatgaaggttgcaccagtcaccgtcgcaatccaagcaacgtgcttcaataacaagaagatggccacacctagtacccaacataatagcgcaatccagttcaccccatgatgataccaatactgtcccttagagctcgccagttcgttgatatcatagtgctgacgatgccgccaatagtaatcgactaacatcacgctgatcatcggtccaagcaccatcccaatataatctaggaacgccgtgaatgcagctaaaaaactccccatgattaatggaatcagtgtgactaacgtggcaatgattgtcacggcccacagtgctggtcgtaaccgaatccgtgggaagatattcgacagcgccgaaccagccgccaataagtttaccgcgttcgccgtcatactcgttaagacaatcaccagtagtgctaatacccccaagcctagtcgactcgcaatggtactcgggtcagagttattaggatcataagttccagaagtaatcgcgatactgatcgtcgcggcaagcccgataaaggcgaaccagaacaagccggtaaaggcccctaaaaatggcatgccagtcgcgccactctttttgcgcgtaaaccgcgtaaaatcagcacccgctgtcacccaagacaaattgaacgccgctagcgtatccatcccagcacccgccgtcatatgtaaatgtgtcggcgcctgccacgttaacaaatcatgcactgagaacgtctggaacacgacgaccgtctcccataaaacaaataagatgacaagaataatacctaaacgttcaatcatctgaaccgaccgttgaccgaccgaaacactcaataaatgcaacacactcatgacaataattccgaggatcagtcctttagccccaccgggtttaccatagactggccagccaactagatcgtgtaataaatagctgacagaagttgctgcaatgaacgtgtttaccgctgtccagccaatatactgggtcaagttcacaaaggacggaacgtaactgccccgcacaccaaaggaaccacgaatcaagctcatcgtcgccgccccggtcttataccccatgaagccgactaacgataaacataaatacgatagcgtggacgatgctacaatcactttaagcgccgtcaataaaccacacgcagccaatacaccaccaacgtaccacgtgccattattggcattggcgccaatccaagttgcaaacatgtcccaattagacatgtgtcggtgcttaggcgccaccacttctatttgatactttgactcttgctgcacatcgttcaccctttctacaatgttttccattgtagtttttttagtgacgcttggtcaagtctatttaactaagttagttaattgcacaaaacttaaattcgcattaaaataatcttaataagttaattaaggaagtgacagattgtgaagggcgcattgacaggctggcgccggaatctcgctgttctctggctaggaacatttatcgccggaatgggattttctgaagtcatgccattcttatcattatacgttggtcaaatgggggatttctccaaaaacgaactcacgatgtatagtggtattacatacgcagtgacttttttgtcgtcgctgttgtctcaccattatggggtaaactcgctgaccggcgtggtcgcaaaatcatgctgctgcgttcttcgcttgggatggcctttgttatcggtgcgatgggatttgtccataacatttggatactcattctacttcggttcttacaaggcctgtgtgccggctacattcccaatgctagcgccctaatcgccaccgaaactcccaaggaaagtagtgggaccgcaatcggtatcctaacaactggctacgtgtctggtaacttgatcggcccgattctcggtggcgtactcgcccaagttttctctattcgtttgactttcattatcaccggaattttgctactgatcgtcttcgtattgagtctgacactcgtccacgaaagctttaaacccagcgacgcgccgattgctaaacgtgacggcagtctactcagccaatttaaaaatccaacgttgattatcacactgctcgtctccacgatgattattcaaatggggaataattccatcacgcccattattagtctatatgtcaaagaactgatgcataacgtcggcccaatcaccgtcgttgctggaatcattgccgctctacccggaatttcgacgctattatcggcgccgcgactcggacggctcggtgatcaccggggggctgaccgtatccttgtctttggtttcgtctttgccatcctgatgtactttccacaaggcttcgtctccagtgtgtggacattagggctattgcgcttcatgattgggatctctgacggggccctctttccaacggtgcaaacattattatccaaaaatacaccccgcgagttaacaggcactattttcagttggaatcaatctttccaagcggctggcagcatgctcggctccttacttggtggcgccgtctccggctggttcgattacaacggtgtctttatcttcaccgccttgtcattactgcttaacttcatcggcgtactgatctttataccaagtatgcggcacccatttgcaaaacactcggttgattaaccgcgctatttatcaagttcaaaagctatcagcttagtcccggagatcggaccaggacgcggaccggctgacaaacactaatccgactagcatattttaaccataataaaggtcaccaatcagcaatcgctgcttggtgacctttattagttattctattccgttagctcttacttcaaatattttgccatgaactggcttactttttgttgatatagttgcggataacgcgtgtatgattccgcgtgaccagctcctggagccacccataattgctttgacttgaccgtcgtagcgcggtagttctgatataccatcttcgtggggacaaaagtatccttagcaccatgaataaagaagattggcaacttattcttcttgagctggtttactgaactcgccgtcataaagttgaagtgggccttcgcttgagctacccagcttgccgtatacagcagtggaaacttcggtaagtgatatagttgattcagctcatatcccaattcatcaccaacactggtatagccacaatcttcaataatcgctttaacttgtgatggaagtttctcgccactcatcatcatgacagtcgcaccacccattgaaacgccaaagagtccaatctgactattttggcctacgcggcgaatcacctgtcgcgtccactttagatagtccaaccggtcaggccaaccaaaaccatagtaatccccctgactctgaccattgccacgatcatccggcgccagcacattatatccttggcgatgccacaatcgaatatagctcgccatctgctccttgttacccatgtaaccatgcgccacaataatcgttttggtggttcggtgcgcagctggtacatagtccgcaactaacttcaaatgatccgttgcggacgtctcatgccaggtctgcttgttgacccgtttcagccacgcttggttctgcttcaacttacttttacttttactagaactatggttcaaaactttcggggtgggttcaaatgcaaagtgatataaataaaaactaccgcccgcgaccccgatgacgattacggtcaagaatgtaatgagcgctatcgtccattttttgcgtgttgtcatattctctttctctctttcatacctaatcatatctgctaagcctaattcgctttaattcgaatacgctacaagcagccatagcgatattatcaaacgctattctcaattatgtgcctatctcaactcaatctaccaattcgttaagcgctcggatcgttaataaatgtgccgccaccgtttgagctgctaattgaattgcccgtgctagcgggtcaaccgtcgacaagacgaccggttgtccagcaagcgtagactcgaatgcttgccgaaattgctggtaccgcggctcaatctgacgcgaatcacgaatttgcaaaatcgctttactaattactggtaatgaaaaatcagtcttcaaaattgaaacgactagtaccgccacaatctgattccgggtataccgatgtccaaccggccgactgaaaaaatgttgtttcacgtaactattaatcatcgtcttcgttacggcaggtaaccccagcggctgaattgtttcattaacaagttgcaacaactgttccatataaacgggcaccgcgggcaactcttcccacgaaagtaaatagttactagttgatccaaattcctccatcatccaatcctcctcactaccctatttaatttagcccaatttagattttaattcaacaatatctaattgttaccttattataaatagaattataatctacatacccactctgctaattattattcgcttcaaaaattattaaaagatgcttatttttggattgctgttcgtcagcaatgatcgtcctattccgacctccggggctgggtgacaattactggaacgtaagccgacgtcgatttgagcccgtgcacaacccgcccggtctcaaatacgagtcttattctaagccggaagcagaccacttccgactaagaataatttggctactgagcattgtcacccagcccctccagtctcaagcctgcgaggggccacgggttgaagccgagcattgcctgccaacggattaatgcggttttggcattagtccattggcatagcaagcacaggctttagtggcaccgaacacgtttcggtaagccgctcgaatggctgatgaacggccacttaacttagcacaatttatcgttgactattttgatattaaacaaagacaaagggttagggtgcactaggcactctgtcaggagtttgaatcttactatgccgattcaggattaatgagctacctcaatatcattttcagtttgacagttgattaacaaaattactgtttacaaaaagcaacggcaaattcatcaaaagttaagtacagcttcgtctgccattcgaatactctcccgactggaaggcgtttctgacaatgcccagtggtgaaatttcacttagcaagtgtcctgtgcttggttattgaaaggccagtatttgagacgtgatttttcggctcaagtctgtgcccaccacgttccggcaattggcagaaatgcctggaagtcggtgtaggacgaaccaaccaagcatgtttacgctgattcgaactttttccagcgggcctaagctggctatttttgaactttcaaaataaggatcttttaataatgattcacgccaaatcaaggcttgaaagccaccccatatttccgctaaaataggcttatccaaattttgttatccagaaaggaaatcattatgaataacgtttacctagctgcaccgttttttgacgaggctcagaaggaacgcatccaacaagtgaagtcggcgctgttggctaacccgacgatcaaccgcgatggtatcttcatcccagaagaacatcaatttgaagaagaaccttttggtagccgtgcttggcaacaatacgtctacgcatccgatatgcgtcaagttcatcgggccgatgtcgttgttgccattcttgacttcgacatgactagtgcaaccaatgagccagattctggcacaatgtttgaaatcggtgcggccgtggctgaaaagacacccgtcatcgtcgttcagtttgatgcgaataaagaactcaacttaatgatttcccaaggattaacggcctatttcgatgctagtaaagatggtctgaaagaattatctgcctacaattgtgatgacttacgttctaagcccgctcaccggccagtattttaggcacacaacttaatgacacgaaaaaatgctgcttgcaaacgaataacgtttgtaagcagcattttaactaacttgaattgatcatccttattcagcagtattcacgactaatcgtgactgtcgccgcgcctgccagcgcttattcaattccagcacgaatgttggaatcagcgtagctactagcaccgttaaccagcctaacgctggtagtgtcactaagctaaagaaactacggaacggtggtatcactgcaattgccaagaccaccagaattcctaacagcaatcctcggttcagcattggattacgcatcatgcttgaccagctgagtggtcggcgatccttaattgcatagatgtcgatcattgatcctaatgccaatactagaaagaccatcgtcatcccgactggggcttgaccatttgttaagccaaagcggccaaacgcgtaaattccgagggttagtacggtaaaagtagctgcccggataaacaaccgttgaccaaggccccgagctaaaatactttcgtcattggctactggtggttgttgcatggcttggggttcacctggctcttggctaataaagaatcctggaatcccatcagcaagtacgttaataatcagcaattgttctgctaacagtggcgccccccaaccgaagaggactgcaccaaccatcaagaagatttgtgcaaagttgacacctaccaagaattcaacggctttaatgatattctgataaactgtccgaccttccttaactgctgccatgatcgtcgcaaaattatcatccgttaacaccatgtcagcggcttctttagatacttcggtacccgtaattcccattgcaatgccaacattcgccgctttcaatgccggcgcatcgttgacaccatcaccggtcatcgcaaccgtcttaccaagactttgccaagcctgaacgattctaattttgtcactcggcgacactcgggcgtacactgcaatctgatcgatttgagccgtcaattcttcatcgctcaattggcgtaactcatcaccgctaattgcttgcagctcaggggttaaaatgccaatttcctcagcgatagccttcgcagtaaccaaatgatctcccgtgatcataactggaaaaatacccgcctgtttggctgctcgaatggccggaatcacttctggtcgtggtggatcaatcaaaccaatcaatcctgccaattggaggtcagctgtcaggtcgtcccagtcagtagtttggacatccgcgggaatgatgcgatagccaacagctaaaacgcgaagcgccgcctgcccaaattcatcatgggccacttgtccagcagctaggctagcttggtcaggcttcagtggtaaccgatcccaagcccctttgacgataactaaccgtcgaccatgcgctaattcatgcaccgtcgtcatcatcttcttagttgagtcaaacgggtcttccgcaattcgtggggtctgcgcctccaagctgggccgatctaaatcatgctgagccagccaacgaataacggctaattccgttgcgtccccaatggcttgttcttcaccgtcaacgtggttaatctcggcattcgtcgctaatcctaagtaacgcatcaatgtttgtcccgctgatggcaagggctgttcggtcgtcataatgcccgtggtcggcgtccaatactttgtaattgtcattcgattttgcgtcaaggttccggtcttgtcagacgcgattacatcgacactcccaatcgtttcaacggcactaactcggcgcatgatggcatttctgtctgccatccgtcgaacaccgtgtgaaagactaatggtcacgatgatcggcagagtctctggcacggccgcgaccgctaatgaaaccccaatcatcaagctatcggccaaaccttggttttgcacccaaacactcagcgcaaaaatcgtaataccacctaagacggcaaatgtcgttaaccagcttgatagccgattaagccgcccctgtaatggcgtggcccgttgcttcgtcttgttcaacaaacctgcaatttgacctaactctgtggccattccggtcgttaagacctgaatcaatgcagtaccggctgtgacggccgttcccgcatacacttgacagttatcatccaactcaccggtgtcctgataaatacttttttcaacagcttcactttcacctgtcaagactgcctcatcaacggctaagttcgtggcctctaacacgaccgcatcggctggaacctggtcacccgcttttagtagcactaaatcaccgggaacgatttctggtgccgcaatcgtttgtaccttcccatcccgtcgaacattagctgtgggtaaactcattgacttcagtgccgccaacgacttttctgcggaagcttcttggtacaaaccaatacagacattaataactaaaatggcgccaatcacaatggtctttgtccagcccccattctgggcaagagccaagtacgtggctaaaccaactgcaaataataacactagcgatgaaacgtcgctcatatgttgccaaattttacgccataacggtacggggcgcgcagctactaattcatttttgccgaatttagttagctgggtcgtcaccgctgtggtcgttaaaccggactcgggggtaggtttgaatggtgcattctgataattctgcatcgtttattcctccgtaattcgattatcgttgtcattcgtcactattaatgatagcggaaacattttgtcgttttacgtgcaaattgtgaaaaagtcgtgaagattagaacgtacaattaaaacagtcattaaacattaaccacaggtcatcatcaaaaaactgttcaatttatgactaaaatcaagttaccagccatgaatattgttataatagaacacaaatattccttggaggcacgttatgaaaatcaaattaatctcaactagtgatgtgcacggttacctcgcgccaactgactacagtcgtcgtgataacatcgcaccatttagtcttagtcgtgccgctactgttattcatcaactgtcacgtgaagatacggctgatgtctggccaatcgtgattgataatggcgactacgtacagggatcaccgttgacctatttcattgctcgccaccaccaagaagctgcaccgttatactcgcgccttgcaaattgcaaccacgttcaagctggtattttcggtaaccatgaattcaactacgggctcgactacctcgacctgtgtgaatcaagccgccaatatccgatgctggccgctaatattcatgatgacctgcaccgcaccttattctccaagccatacacaattctggaacgcgccggagttaaagtggcaattttgggactaacgacgcaattcgttgcccactgggaacaaccacatcacattgccggcctgcactttgaggacgtggttgcaactgctaaacattgggtgcccaaattgcgccaactggctgacgtcgttgtcatcgcctaccacggtggtcttgaacgcgatccccaaactgatcgtccaaccgaacgcatgaatggtgaaaaccgaggttccgcactattagctgaagtccccggcattgatgccatgattactggccaccagcatcgacaattagccgttacggttcacggtgttcccgtgacacaacctggtatgaaaggtactaatgttgctatgattacccttgagctcgaccgcaatcatcaagtgacgaccagtcatccggaaatctatccggtcgcagatgccacccccaatacccaggtaatgcaactagttggaccaatcaatgaccagatggaagactggttagacacaccacttggccaaattaacggcaatatgctcgtacacgatcatcttcaagcacggctgcataatcatccttacatcgattttattaatcgcgttgaaatggccgcaaccggtaccgatattgccgcaacggcattatttaatgacgacgtaccaggcctcaaacaacacgtgacgatgcgggaagtcatgaacagttacgtctacccaaacaaacttgccgttgaagccattactggtgctgatttacgcgccgctcttgaacgttgcgcgagttactttctcctccaagacggacacgttcgggtcaatcccgagttcatgcaccctaagttgcgccactatgtctatgatatttacagtggcatcgactatactttcgaccttaccaaaccctttggtcaacgtgtcgttcaactcgattatcatggggccccagtcaccgctgaccaaaaattaacggtcactctgaatcattaccgcgctggtggcggtgggaattacccaatgtatcaaacagctaagattatccggcgcttacctactgatatgaccgtattaattgccgactactttgcgcaacatcccgtcgtcaacgcaacgcaaccgactaattttcaagttcactattaagactaacgcgacaaacccgctcaaatatgcactatttgagcgggtttgtctatactgacgttcagaacgtctggtttagcatcgtcgttaaaccgtgccaattaacctttgtcaatcgggaatcataacagcactgaccgcaagtcgtgccctcctttgtgggcgtctcacaaacccagcatggtaatcaaaaggtgcccgtcatacgagctgcaatccccacattaagaatcccatggtcagcggcgcaatgaccgtacttaacatttgcgtcgccacatactcatctggtgccaagtggttttggacggccaacatggtcgcgatggttgcagtggggattgcgagcgtcaggacgactaattgttggttacttaatgacacacctagactagccataatcccccaaatgagcaccggtaagcctaaatttttcagtagcacgtttaagacaaccatgcgcgtcagtcgccacggtctagtcgttaacagaagtcccagcgcaaataacgccacgcccccagctgcttgtcccaactccgtaaaattcgttagccaagcactgggcaaccgcaatccggccaaatttaagagaaaagcactgattggcgcccacacgactggttgccgactcgcacgacacagtttctgccaaccggctcgccaacgttgctcaggtgtcgaaccgcccgctagcgttaacagcaacacgctcactggcacttgtaccaaattcatgtacaggccgcctaacgcgaccaataaaacactgattttaccaaaaaccaccagtaaaacggaaacacccatgaatggaattgaaggactggcgatcactagcgctcgtaatgtccccgtttctagttgttgatggaaacagcattggctcacaatgacgataaccatgccacctagcatgcctagcgccaaccacagcgctaccgaggagttttgaataatggtagcgcgctttaatgacaagattcctccgaaaagacttaacggcaaggcgtaatgcatgaccaactgaatcaaaatatcactggtcgttggcgcaaattggtgccgtagccccgcaaacacgcctaatcccaccgtcacaacaattggtaaaattgctaatatcagtaacattcacaggcccccagacttaataattaaaactgagtgtaccatagtccaatcgctgtgatagtcaggttgctagtcaacaatcggacatcttatgacgtttcattagtctaattaggggcctacctcatattattaagcggccgcgccacactttttacgataacaacgaattttctaatttaactagctgactccgacaattaggtgattagccaaataaaaaggatgctgccagtggctgcatccttaataacgatgaaacttagaaattaacttgatcaggatcattagctaacccggcaacaccgtggaaaccatcaatgaccttcatatcatcatcgctgagttcgaaatcaaataattccgtattttgtttaatccgatccgcatgaactgattttggtaatggtaagaaaccgtgttgtaatgaccaacgtagcacaacttgggcaacgctcttatcatacttatcagccaacgtctttaattctgggatactgaagatcttaccagtacctaatggactataagcttctgataaaatgtcatgtttgcggttgtaggccacaacttcatcttccatatcactaggattgaggaagatttggttaacggctggcacaaccttggctgtcttaagcagcgcgtctaaatgcttaggacggaagttagaaaccccgatagcccgtgctttacgtgccgtgtaagcttcttccattgcccgccaagtatcggcgttcaattgttcccaattgtcgcgcattgcggctgggtttggccagtggatcaagtagaggtcaacatagtccaaacctaacttagccaacgaggtatccagcgccttcttggcagcgtcatagccatggtcggcattccataatttggtcgtgacaaataggtcttcacgtgccacaccactatcggcaatagctttaccaacactttcctcgttaccataggccgccgccgtgtcaatgtgccggtaccccgcctttaatgcggctaatacggaatcgtaagcaacctgaccatcaggtgtttgccacgttccaaaaccaacaatcggaatcttagtgccgttatttaacgtgtacgtatcggtgagtttagtcaatgcagtcatcaaaaatgcctccaagaatttatttgttaagataattctacccataaccgaccacttccggcaaacattctgttccaaactaatgacgatacgcaaaattcgtgagaaaatataaacattctgatgtgggaggggttttgatgagcgatacggcagttatgttaaaaaccacgttattggccggcgccattttgctagaaaatggggctgaaatcaaacgagttgaagacacgatgcaacgaattgcaaccaacgcgggctaccctgacgcgcaggtcttcgtactgttaacagggattaccgtctccttgccggaaaatgccactagcgaagtgcgagcaatccataatcggggtatggacctcgaaaaagtggatcaggtcaacagcctgtcacggcagtttgctaatcacgatattgatttaactgaatttgccgcagccctcgaacgggtcaatcaagccgtaccgaccttcccattcagctggttatgtctagcggccgttgtcgttagtgtgccgttgatggtcgcctttactgggcggacaactcctgccgacttgatcacttgtgggctagccgggttggctggttttgctgccttttattggatcaatcggttggggtcaattcggtttctcagcgaatttatgggcgcttttattattggtctaattaccctactcggcttttatctcactaacggtcattatcatcccgacgccatcattattggcgctgtgatgccattagtgccgggtgtcgccattactaatgccgtccgtgacacaatgacgggtaacttgctgagtggtcctgcccgcgctgtagaggccgttttatccgcgtgtgcgattggtgttggtatcgcactgacttcatttttctactaaaggaggcgtgacatgctacattggctcttaacaaccggtttatttcaaattatcttagcttacttagctacggctggttttggggtacttctcaatattccgcgtcgcgccgttaacctcagtggttgggtcggtgctgctggctggtttacgtatgaggtcctctatcacatcctgccattaggaatcgacgccaaacttgcgattggtaacctcgtcgcagctatcgtgattggcgtcgctagcggtatggccgcacgctacaaacgaatgccgatgatcatctttaatatcccaagtctggtcccactggttcctggtggccagtcttatcgagtcgttcgtaacttggtcactggtcaaccagacttggcctaccagtactttgtacaagttgtcattattgctggtgtgattgcaattggctttctcgtcgctgaatttatcaatcgcattactttacactttgtttaatcaggaaaatcagctagtgcatctttgtcggttagcaaaatgacaccacgttatcttgatttgcagctgctagacttcttaaatgattagcaaaaaatagataacgccttttactaagtacttacaataaaagtaagttaataggtctaatatagttcaaattgtgggcttataagcctgcaacatttacaataataattgtatttaacccgcgattttctaacttggagggagaaaagctcaatttattatttagatactgacaaaataagcttagaggaaaagaaaatacccttggtacgattggtataaaattatgaccttcattaatatttttcaaaactgtaaattcaattaaaatactgcctaattaagattctacagctgcaatttcaatgtgattgcgaagccttaaaaagtagtatacgaggagaatattacaatgaatactaagtctaatcatctcatcgaatggctgctcaccttattattaataatctcaattctgataaatgttggttggtttatttttcgatatggcggtcattactactacatgaaaatatcgagtagtaccggaacttccccaattacactaccggtcaatgtcccagctactgggtatcaataccaaggactagcaactaattctaagggcgaaaaaaaagtatcttcattttaatacagttgctgctgatccagccccattcaaacgcggacaaattgtcagaatcacattcaatcaaaggtacggcgtaaccaactataaattagttcatcggtaacacgattacttcaaaaaagtcgtcataacgattggtttatcacttatccaatcgttatgacggtccatccattactagtaatgatataatctaaaaagtcagcaactaatttatagtcgctgactttatttattcatgatatttgcggcaacaagcttagccaaaagttacgcttctagtatttaatgaatcaacgtaaagtagccaatcacaagtacccccaggacaattcggtaccaaccgaacgccttgaagtcgtttttcttgatgtaatccaacaagaaacgaatcgacaagtaagcgactacgaaggacacgatcaccccaacggctaagactgctccttgcaaaccagctaaagaaccaccgtgagcaaagaatttcacaagcttcaataatgacgccccaaacattgttggaattgccatgaagaatgaaaactcagttgcgacgtagcgtgaagttccaatcaagatagcccctaaaatggttgcaccggaacgtgaagtccctggaatcaacgagagcaactggaagcacccaatgaacaatgccgtcgtataaggtaacgtttgtagattagcgaagcggggtgttaagcgcttattatgattttcaatcacaatgaataggaccccataaataatcaacgtggcagaaacgaccgcccaattcattaaatgttcgtccatccaatcatttaacggtagccccacgaccactgatggaatgaccgctaataacaccttactccagagaacccaagtatttcgcttttccgtggtatccttgcgtggtgacaacggatttagtttatggaaatacaggacaacgaccgccatgatcgcccctaattgaatcacaacgttgaacatatccgtaaactgcgtggactgttgcatcttgataaattcgtcaactaggactaaatgccccgttgaactaattggtaagaattcagtaatcccttcaacaatccccaagattaccgctttaaaaatatctaacacaatggattcctttcttgttggcaatgattatcgcttgataatcccaatacataaagatttacgaccatccccgatggccggtatatcaacattatagcaagcagctactcaagatagtagcgtccatgtgtatttttttggtaaagattaatttgtcagcgctgccaacgccgtactaaatacattttgcgtttggtcatcaaaacaaacaatcgtgattgtctgaaccgtgtgggccgttgtctgcgcagttgcttgtaacgtttttaacgctaacggtgccgcaattgatagcggaaagtgatagacgccggtactgatagacggaaaagcaaccgtttgacaatgattctcagcggccaaattcagactgttgcgataactgttcgctaacaattgtaattcattatgctggccaccttgccaaacgggacccggcgtgtgaatcacatacttcgccggtagtcgaaagcccggcgtaattttggcttcaccagttgcacaaccgtgtaatgggcgacaggcagccagcaatgctggcccagctgcccgatgaatggcaccatcgacgccgccaccaccaagcaaactcgtattggccgcattaacaattgcatcaacggtcattttggtaatatcaccgtgaatgactttaatctcaaccatcttaaactgcccccataatcagatcaacactcgtttgggcctgttgttttagctgtgccccactaggatcctgttttgccaataactgaatgccgctgcgaacctgcattaaacttactgcagcctcagcgaccgtggtcggtaaggttttagcctgaggtgaaagtaaaccgacgagtcgggtctgtaaatcagcatagatcgtttgcagttgggccatcaaggacgcatcctgcgacccaatttcggccatcaggttcaccatcaaacatcctgctggccaccgttcactctgaaatggtagtcgcaaacaagccgcaattaaagcgggcaatggcgtttgccgcgcccgctcacgttgaatcaattgatcaagttgttcatctaacgttatttgatagcgttcaagtgaacggcgtaacgcaacccgcttactgtgatactggcgataaaactgcgtgcgtgacaactggctaacggtgagcaagtcgtcaactgtcgtttgataataaccacgctgccaaaattgaatcatcattgctgtttcaaccactgatgcgtccttaacaaccatgctaaaccctcctgaacctaacgctactacattaatcagcaattaaatactgaattccgcgaataatcgaccataagtagctagccactgcgactaatccaaataccgctaaaagcaccacggccaaccagccactattaacgatactgtccatataaataccgctaacgcctaaaatgacgagcaatgtaattcctaaaattgtcggcaacaaatgtaaccaaaaagcccgtcctgcaacccgatgtgcttctggattagtactcgtcagcaaccaaacaattaatggaaataaaactggtaagaataaaatgcttaaatagctcaacgcgttaatcacccgattttgtgtcattgttataacctcccccgatatttatttcgagtatagcgaaagtctggtacttcggcaaataataaacaaattgttaaaatacttaggactctcccaaggttacgcgccgaatgttaacttacgaccacggtctgctataataatgacataacctaaccttgcaatcgctagttgccactgtacaacccgggagcgaacggttcatgttaggatttaggtgcattagttaagatgcggaggaaaagaaaatgacgaaacgaatgagtttcaaatttaaatgggttgccctcgttgccaccctgatcgttgggcttggcagctggcaagtccttgcgcacgctgacagtagcagcgatgaaccaattgtcacattaggcaatagcctgactagcagtcaaaagactgggacgatcaacacgttaacggctagcttgaacggtgccgattatcagacgctaactgttaacggcgatactctagttaaatacctcaacccagccggtgaaagtttcacaagtagctcaggtgtgtggtccagtgcgatgattcaaaaaacaagttctggttctggaattaatgtcaaaattttaaattataatggtagtaataacatcaccactattacggctaaccagtataaaaacgccgccctaacggctgggattaccgatgctaatatttacgtcacatcagctactccaatcgacggttcgggcgcactagccggtgtttacgcggcgtacgcaaaatctggtaacagcttaaacacgaagcaagtaactgccgcccaagatgagttaagtactctcagtggcatcacccaagcaaataagagcaaggatggttatactgattcccagttgaacaacgctgtggctggtgccaaaaaggaaatggcccaaaaaggaagtaacatcactaaaaacgaaatcacgaccattgtcaatcaacaaattaccaataacaatttaacaaatgtcattactaataatcaaaagactgaaattattaatttgttagtcaagatccgtgattcaggtgcattagattcttcaagctttaagactcaagccaactcgttgatgaagaacattcaatcaaatgccaagggtgtcttcagcaaactcaatactaaagaaaatcaaaacttgctccaaaaaatgtggagcgcgattgttaacttcttcagctctattttcaaatcaatctttggctaattattaatctcggatactcaaaatcggacgacaaaactgcaatcagttttgtcgtccgattctttttaagccttgaagcataccattaaataacgatcactggcttggcaaactattcaattgccaagtgatagttccagaataatttttagccatcacacgaccacccttgacgtgcaacgcaacgttattaacattccaaatttgttgattagtcccgacgccttgttgactagtcgtcccagctattgacgtttgttgggtagcacctggggttaacttaatcacggctggtaaagttgcctgattttggtcagttgccgtaacccatttactagtactagcattcaagtattgcgccgttcctgatgttaacgtcacgtaactacccgtcatggtcgtcccatcagtagctgtcaacgctgataattgggccgtcaattgccaaccacttggggtgtcccgtgtatcagtcacttgtgtatacacactatcctgcccatttttctgaccaccaactgttgcatacttctgtccatcagtagcagtagccaattggtcttcagcggctgatggtgacaataatgggtacgctgtatccattgttggaatgctgtgctgtccaaagttcaaatgtgtaggtacagcgtccaacgataatgggcccaaattgttcgtcccgccagtcccaggcttgctaggatcatcaggatcaattggattgacgattaaatccttagctactgtaaatatcggtgctggttggaaagtcgcatcatgatactgctgcccatttggataactattaggatcaggattacgatttcctagactatcagccatataaataataatcttgtcaccaatttttaacgataatccggttaagttcagtgaccaagtcccattggcattgacaaccgttttgacattagtttgaatctgcccattcaatgctaatgtgacctgcgcacctggttctccattttgaccactcaccgttcctgttgaaactctaatggggtccggtgataccattgtggccggattaggcggcgtcacatcaaccaccgtcccggtagccgtgaccgtcgttccactggtattgctagtcgatgctgtgaccgtcgttccagcttttaaaaaggtcccgacattagctgttgcgtagccattactatcagtttgggcagtgattgtcttaccattaacgctataactcacggttaattgccctgcactagcatactgtggaatataattaaccgttccgtcatcttgaacaccattagtatcaggaaccatcgccacaatgactcgcgtccgcagcttctgatccgcatctgttagcttggttgtcccatcatacggattattaaatgctaattgtggcttctggttagtggcactaatccgacgcattttagaagataaataattactttgcaaattactatccgtggccgtcactgctgaaccctgttgtaataactgagatacgttactatacgaataatccgcaccgcccgtaaccgatgatgctaatttccacaagctaatattactatcttggatttcaaaagtgcccacattatcttggttaatcgaactagccgctgcagtcgttccagttgagctattacgtaaatccaagttgttcggattaataaatcgaacagtagccaaacgcgcgtaatttcccgaaataagcggtgctcccgtagcagcaattacataaatattggcaccactactactttgaatcgtcgaagttgcattatcagaaaaagagattggcgattgacttctagctagtgacgttagattaacggtgctaccagtatccgcgtaaaaattacgatgatattgtgacccataaaagtacttgttagagtatgcatttcctggaacgctagcattaaacgtggcatttttacccacattaatactttcatacgcatcaaaaataaccggataggtagtataggcggttgacgtagaactagcaggtcgtcgaatacaatttagcgtcgcgccttcttcaacattaacttgccgattaccagttccttgatagtcataaacaaaccagataaatgaattatcatcaccattggctattttcgatccagtgaatgtctgtccagcagctacatcaaggccaccacataagatgttttctcgaaccgttgttactcggcaattgccggtaatattgacttggttcccttgcgcactgacaaatcgccgacttgtattggtataactagtcccacttgggaccgtaatattactaacattaaatgtccaattcaaagcccctccggcaccatcgccaccggtggatgagccaatcaaacccgcatcatttccaaaagatccgattaatgatgcaaaattcataaaggtcgctgtatatttcgtactactggtagcaccgttgtacctagtgtgaaacccagcagatccagtattaacgctatgtccattcccattcacaataatattaccggatagtcgtgagtccaaagaccctgcagcggcagtcggattactaatatcagccgtaatattaatttcatcaacactcacattcttccaagcatcgactaattgagaccatgtactaacatcaaccacattcgaactcagctgagctaaccgagtgactggtattaatggactagatttggcactcgcagttgcttgcttagttgatgctgatgagaacacttgactagcagtggatgacgacgagatgctggccgaactatcagttgtcccacccgcagattccgtgaccgctgacgattgactagcagcagtttcttgtgaaggctcgctactgctagcactcgtttggtttaccgcctgacttgaaagcgtcgttgcagctgaacgtgaactgtccaaacttgctgctgatgatgtcgcttgtcgacttgacgatgccgtcgaactatttgtatcggttgccgctgaagaactagctgaactcgtactggcctgatcagcctgcgtttgtggttgcttaatctcgacattcaacgccggccctttttgatcatcggctacagcaactaacgccagtttttctgctttaacagctgttaatctaattggtaccttcgtttgcggatattcatctgaccactgaaccgttatcctgcgcttatcaggattgtacgcaactgtcagatgcttagccgtaattgtaaaggcaccattatcccccgttgtgtactgactatcatcgaaaacccgttttatttgcttaaactcctctggcccatctaaattaacctcgttcggtaaatcaatcgtatttattttagaggccgtatcaccaacctgtagttcaacatcaaaatgttgattcgttaaaatattatcgctagccgttgattttgcaaaagttaactgtggtaacgtagctgcttgagcggtcatatcggcgcctaagcttaccgttgcaccagcggctatgacttgtaacaataccatcaatatgacaacaattgctcttagctttttgatagtatcaccccttagcgcttattttgacgccgtttaattacccagaatatgattaaagcaatgagcaataatactaacaacacgataccaatcaaccaaccccaagtagttggagacgtgacgttaacagcatccgtagcgccaactacaaaatcttgctttagcgaccagacatgcggcttagcgaacttttcatccgtagttcgatacttgacgtatagagtgtaagtcccaggtaaaatgatcccccgattagtacgccactttaacggtaagtcaaagttagaattaggagccatcgaactactttttagatcagccaccgcgagctttttggtctgcccagctttgctaacgtaggcagtgacagtccctttgcctagaattgaagcgtagtaattttgaatattaccgataactgtcttgatgccactccgcttttttaattgaacatcagccaagcgtaattttggcaatggatcacgatttgacgttagtttgatccccacattgtaggcatattcgctagttaacgtcgcccccttggttttaagatgttgatctgcaattttaacttgccaacttcctaaaataatccctttgttcaatttcgttggcgtttttaactgtgcccgcacgatccgtgatttattagctgggatcgtcgtttcctcatccggtacggtaataatatcagctagttttacttttaaactagtatcatcattcagattagcagcaccataatcaataacacctttcgcattagtatacgattgtaggaattgatttttgactttaatttcatgatttgagcgattattaacacgcatcgctaacgaatatgttctcttcggttgaattttaaaatcccaataataagcgtcctttgataattgttgcttttcattaagcattggctgaacatcaaaagttaccgcattattggccgtgtcagcagcatggccaatcaccgtcataccagccaacaaagtcattattagggttaacatccctaataatagcttcttattccagccgttcataaaagggcctcccttcaaaaaaacgagttaactattcaacatagccactcgttttcgttcattaagccgttggtgtcgagttcaatgtccaaacaatattccctgaataattcttagcggctgcgtgaccacctttaatcagaaagctgtgcctttaattgccagccagcaccagtcccccgtgagtcagaaacttgcgtgtaaatgatatcattaccatttttcttaccactagtcgtcacattttgggtcttatcatcattagctgtcgcaaggctctcctgactagcatcttttgaaagtaaagtgtaggccgtatcaacattaggttgcgtatgcgtcccaaaattaagatacgttggtaccgcatctaacgaaagtggcccgttgttcccagtaccaccgccgccaggattatccggattgtctggatcaacaggattagtcgaaccaccgttagacgtaaacgaaacatctgcttgagactttccagttgaaggcaaggtgtccgcggaagctcctaaattattgaatgataaacaagcaatactggctactgaaaccagcatagctgctttgagcgtacgtgactttgtcataagtcaattccccctaaaatttaattagcatattaatcttcttcatcaatagcgcgtaatacctttttgtacaaacatattaatatttaaatcaatattataaattcacctttattaataaacttttagcaaactaattgacgaagaatatttatatgtctatactggataacttaaatcagtcattatccttgaaccaattaaagcataccaattaaagttaatcaagtacactattatgtacgtttactatttgtataaaattcactatttttgtaacttatgggggaggaactgtccattgaattttccagagctcaaactttctcaaacagaacgcgatttcaattttgattttgctatattggaacatgatttaagttattttttcgaaaagcgttgtcttgactacgccttggaacatatcaatagatttaatcacaaaatcaaggataacttatacaacgtccgcccactcattctaaaagaagccttaatttcactaacctgtgatctagcaagtgtcagcttttatcattatttgaacatgatcacattcgttaacttaagaaaggacattttgcattacctcacaacaacaacactaacgaatgatgattttatgccacttttagagtcaatcgttaataattattttagcaatcttgatacacttgatattccaattgatggtacccgcctctctaagcaagtcgcgctagttgtctattatattgataatcattgtgatgagccattaagagcaaataccatcttagaagaactgacgttagatcctgaatacactaagcgtaaatttcgtaaagaactagggtttaccatcaacttctacattcgccacgctaaattacagcgagcaaagcaattattaattaatacccatcttcctataggtgaaattgcagaaagaatcaacttctacaatagcgccgaatttgcacgccagtttcaaaaagaattcgatattactccgagtaaatatcgcgagttgaatcaaattttttataaagaagaataaataggatatttactttgtacaataaaatatttttttgtgttttaaaattcgcatataagtttaatcactcttaaacttgatattaattctgcaatatcaagcaagctcctaaccaaaccttgaacgcgctattaggttaaaaggcaaccaaagttcatatgagtaagacgagtatttgtccgctcgtcttatttatacaaatcacccaatcaatgtgactactatacaaacagtaagcgctcactttttccaaaaataattactaataagtcttattttaagtacaagcacggattatatctgatagcgcaaacaaccagcttgacacctattacatcgagacttcatagcacctatcgtcttgatcatttccgaatcacgatcagtggtcattaatgattataaaaacaaccctgttagcaccaaaagacgccaacagggttgtttttgtaattatctttaattgtaactgacactcaattaagcttcagcccgcttcaaatcagtatcagcatacgttgtctttttagtttgcttgctagcatcttcattaacaaacttgtccataaactcttcaaccaagttcaaagtctgatattgtttagctaaactgaagctttgacgccattcccggttgcgttgaatcaattcagtaaagacttcatgttcaatccgagcgccttctggtgttaactttaaaactttgttacgacggtcatggtcttcagcttcttgatataagtaatctttccgtaataagcgaccaattaagcgtgagattgctgaacgcgtcacaccgtgactttcggcaatatccatcagacggatcttaccttttgcttcagcaatatcatataaaatgtaaaactcatccaaagtaatcccatgttccgttgcaggttcagcaaacatatctgataagtttttaaagccatgtaaatacatatggctaaagcgattaaaaaattccatatcttcattcattattcaagtctccctttcactagtcgaattatcattaaattcccaatcataattcgccccatacttttttcataaattagtaagcgtcgtttatcatttccccactttaaagtgtactagtatattttacgaaatacaagtaatttagattactttaatattaaatttttatttcagtactcaagtcaagggtcgcgtgtttatgcagatacgtgatgaattgctgataataatagtcagtattatacttggctgtgctcaaataaatttgatcaattttctcagtattctcacctaataacaagtaaaacgcttggtcgatattttctgcaatcatgccaacactagctcttagaattttacgcttgaaaaaaacagccataccaccagataacgcgaagttcaacgcgtatctaatcatagcagcttcaccttctacgccgatagcttctagccagtctagtgtcactagcaccatctcagtcgtcagttccggactctcgaagatgtcctgaataaagtgttccatggtcggattttcatctaacatccgcaaaacaaagctcatttgaattattgttcgctgatacgaagacagcatggtcagctgttcattactatagataaaagcactaagcgtcaactcatttaacatcgtacttaataaaacgattttcttcgggaaatagtgttgtagcaacgacttactgatatcacaggcaatggcaatgtccttcatctgaacgttcgcatacccctgctcggcaaacaagcgaaacgctgtattaacaatctccattcgccgttgcgtgttccttcttcgtggcaagaaaggtgcctccctatcactgattttcaatcattctcttttaataaactatactaatatagctttgaacgcaagtgataatttaattggaaagttaattaataacagcctcaactatcaaaatgatcattacttatcaataaaatccgcgagtacttccaactacaagttagttaacaaccactgcggcttaacgtcttaatcgtctaaacgcactagcagctattcatcagccaaaaaagaaaacgctttcttatgtgaaagtttgtgctaaaattaacttatcaacttgcagggaggctacaatatgagcactaaaaattcttatcaattagccgatatcggtcgtcataatccgatcttttcacagatccgttctaccgttgaaacggccttttacggtaacaatatgcaccacgttgatgatgtcgccgccgcctaccaccgcgccaccaaggaccccggaaccgttattacggacctcccaatctatcgcgcaacgtatttaggcttaccagctgatgcaaaaatgttaattgccaatacaggtaaggttgttggccgaaccgcacaagcgcgccggattctaggcaacccgggcgttagtgaagccgatatggccggacgcctacgccaagcactatttgctagtgctcacaaggacttcatcacgacggacgttctagtcggtttagacgaagatttcatcgtgcgggcccacctcgcgattccggacggctttgccaataatctactttcttacatgcttaacttccagcccatcaccactgcttatcaagaaatgttcgatcggtccgttgcctatccagaaggcgatatttacatttacgctgaccctacttaccatgatccagattatccagacggcctggctatttttgatccgcaacataatacggctgccattctaggaatgccatactttggtgagttgaagaaatcgactttgaccttagcttggtcgatcgcccatcgtcacggcttcgttgcttgtcacggtggcttgaaggccttccacttcaagaacaagcaagaccaagtcttcgccatgttcgggttatcaggttccggtaagtcaacactaacccacgctaaacacggctataaatacgatatcaccgttctccacgacgacgcctttgtcatcaatcgcaaggatggtagttccgtggccctcgagccttcttactttgacaaaaccaatgactatccgatgacgtccgatgagaccaagtattttatgacgatccaaaacgtcggcgtcaccttagacgatcagggtcgcaaggtccttgtcactgaagacctacgcaacggtaacggccggacgatcaagtcacggtacgcttcgactaaccgggttgataaggaagccgctcccatcaatgcaatcttctggattatgaaagatgatagcttaccacccgtgattaaagtagatgatcccgtattagcagcgacattcggcgccactttagcgaccaaacggagctcggccgaaaatattattggtaatgtcgaccgtaacgccctagtgatcgaaccatttgcaaacccatttagggtctatccactatcagaagattaccatgatttcaaggcactcttcgaagaacgccatttagattgttacctattgaatactggcttctttggcgataagaagattcctaaggaaattaccttgggtgcgctggaagccattgtcaatgatacgaccaagtgggagtcattcgcaggcttggagcacatgcaaaacctaaagttagctgatttcccagttgattatgccaatgcagactaccgtaacttggtcgccactcgtttaggaattcgggctaacttcattgatcaatatcaacacaacaatcatgaccagcttccccatgagattactgatattctagtccacctacaagatcaattaaaacaaccaattacaaaataggatggtattcgttccccgcttcagaccaattaaggttataataaaagtagcaggtatatggcactgaacttttacgaattctaaaaatcggggtgaggagcatggaactaccattaagtcaattatcagaaaagctcatcagttttgaacgcgagcaccatcttacagataacgaccttgcgtttggcagtcaattatcagttgaacggattcacaacattaaatctggtgaagcaacgccaactcaggaagaactgcaactgttgaagaaattcatgaatagcaaagccaaagcttaactgctagttcagcgataaagcctaattggggcaaagatcctcactaaaaactggtcgtccattcgaccagtttttttgttacctaccatccggattgcgttttaatttaccctgttatcacctcgtgctatactcggcacaacttataaagataagggtgaccaacatggcaatgttatacggtaaacacaatcatgaagctgaagaatacttggaaccagtctttggtgcgccttctgaacaacatgatcttcctaagtatcggttaccaaagcattcattatcccctcgagaagccgatcgcttagttcgtgatgaactattagatgaaggcaattcacgactgaacctggcaactttttgtcagacctatatggaacccgaagccgttgaattgatgaaggatacgctggctaagaatgccatcgataaatctgagtacccccgcacggccgagattgaaaatcggtgtgtgaacattattgccaatctgtggcacgcgcctgatgacgaacactttacgggtacctctacgattggctcctctgaagcttgtatgttaggcggtttagcaatgaaatttgcctggcgtaaacgcgctcaagcggcaggcttagatttgaatgcccatcgacctaaccttgttatttcggctggctatcaagtttgctgggaaaagttttgtgtctactgggacgttgacatgcacatggtcccaatggatgagcaacacatggcccttgacgttgaccacgtcttaaactacgtggacgaatacacaattggtatcgtcggtatcatgggcatcacttataccggtcaatatgacgacctagccgcactcgataaggtcgttactcactacaatcgtcagcattccaaattaccagtctacattcacgttgacgcagcgtcaggtggcttctataccccatttattgagccgcaactcatctgggacttccggttggctaacgtcgtttcgatcaacgcctccgggcacaagtacggtttagtttatcccggggtcggctgggtcgtttggcgtgatcgtcagtttttaccgccagaattagtcttcaaagttagttatttaggtggagagttgccgacaatggcgatcaacttctcacatagcgcagcccagctcattggacaatactataatttcattcgcttcggtatggacggttaccgcgagattcaaacaaagactcacgatgttgcccgctacctggcagccgctctggataaagttggtgagtttaagatgatcaataacggacaccaactccctctgatttgttaccaactagccccgcgcgaagatcgcgaatggaccctttatgatttatcggatcgcctattaatgaacggttggcaagtaccaacgtatcctttacctgctaacctggaacaacaagtcatccaacgaatcgtcgttcgggctgactttggcatgaatatggcccacgatttcatggatgacctgaccaaggctgtccatgacttaaaccacgcccacattgtctatcatcatgacgcggcacctaagaaatacggattcacacactgaatcatcacgttattttgataaaatagttaaacttcagaaaacaattattatcactcgtggatacaaaaaatagcaccatccagattctgacgaaccgggatgatgctatttatccatttaagggatattaattacatgtggatagcaaagcttggtgtgtagtaagctgtgctcttaattgaaacagattcgccgtaagttggtgatgcgatgtattggccaccgcctaagtaaatcccaacgtggtaaggtgctgaatcagaaccccagaagaccaagtcgccagcttgtgcttggctgaatgatacgtgagtaccaatcgttgcttgggcataagtagtccgaccaattgaacgaccaaccttagcaaaggcagcttgcgtgaatgcagagcaatccatttgttcgtaaggtgtgtcaatgaaagttttgccagcagcaattactgaactgtatgatgcagttgaactagttgttgatgtactagttgttgctgaagcacggtaggctgttgcagtagcagtcgttgttgatgaactgttcgttgttgtgttacttgcagttgagctagcttgtgaactcgttgaagtagcagctgattgcgtgctagtagacgatgctactgaagttgagctttgtgatgcttgtgaagctgaactttggctagcagagctttgtgaagttgctgaactagttacagcacttgaactagcttgtgaaactactgaactcgttgaagcacttgaagttacactgcttgcactagcagttgaagtactactcgattgcgcagctactgagctacttgatactgcttggctcgtactacttgcactagtagttgatgagctggttgcagcagcactagtagttgaactagcagcttgtgaactcgttgaagttgcagcactagtcgacttggcactgcttgcactagcagcggtcttcttagccgtaaccttttcaccggtcttaacaccaggaatattgatggtcttaccagcaataatcatattaggattgcttaagccattagcttcagcaatcttgtcaacagaaacattgtacttttgtgcgtatgcccaaacagtgtcccctgctttgattgtcattgaatcggcattggcaactgcttgactagtaactaacataccagctaaagcagcagttcctaacatcacttgtttaatatttactttcactttaataatgatcactccaaaaagaatgtcacgtatgtacttcaagccaacgtctatactactcaatttgtgttacataccaataccagcaaaataacaatatgttacgaaagttacaaaaccgtaacaataattagccatcgtaacatttccgcgctgaaaccctatcataccggcatcgttttattactaaaatttgagaccatttagcaactttgacgaaaaaaagttatttttattttaaaaagccgaatttccagtgacaattcctggaaattcggttaaatttcaatttaattacgaccaaacgttcggttaatttggactatttagatattcgttgacgatgatgcgttcgcggtaatcctaatagccatcgaatatcattacccgtaaagttcaacttcaagaattcgccactttgtccctgttgatacatggtcggtaatacctggtcttgcaacttgatcacttgctgtgcgatctcttcgtcaaataaatattgccgtgtcgcagcagcaatttcaccaacagtaaaaatctgagcagcgttagcaaatatctgctctttgcccagcgccaactgggcttgtttaaactgggcgtaggactgatccaagacttggcctgcttgagtttccaatgcggttactgtggtcatgatgcgcacctcctaaatttatccctattgtaaccgccatcgctgactttgaccacgctaaaccatgctttttaaataaaatttgctatactaaaatgacaaaggggaaattaacttgacgaatacagacgatcgttattatcaaccaaccgacatcaaagatgcgcttcaaacaattcaaaaattatttaatacttatactgatgccccattaacacccgaattaatggcctaccatcagaaattagttaaccagttagctactaatttattaccactagcacaacaacaacacgacaaattacgtatcacccaaattaattcaatgatggccgtcatgcaagattggctaaaattaaggctgaatgggcaagttttcggcggcaaaatgcaacacttcaagtttgtcagcaaccaaaaagcacagtacaaacgacgagtgcataaaattcgtgctaatcaaaatcatcgtgctagccgccattgataacgaaactagacttgcacgactagcattttgcggtatactaaaagttgtattgggcccttagctcagttgggagagcgcctgcttcgcatgcaggaggtcgtcggttcaaatccggtagggtccattttaatagacatcaaaaacaaggtgtgttgcaatcaactttcgattgcaacacaccttattttttggatcatcatttatttatatttatcaaagtaacggtctgttattttaacgaatgtactaaattattttcgtttctggttacaagacgctaaaagtatttgattttacatgatatcgctttttttattttaccttcaactatgctccagctcgcaaccacgcattcgtttccttgtacaatcgctcaacttcttctggtcgatccgtccctaataaatcctgactaatttgaccaccggcagcttgtcggacataggctaggaattgatacgaggaccgtaaaccgttaaaatcttgaggtatcacgtgtaaatcctgtcccacaatgactggtcgtaaattatcactttcgttaattgaggtcaatcgactaatcttccacttagtatcacggcgttcgacgcggtaaatcagtcgccgatatgattctaattccgctaaagtaccattgaccatcatgcgcatatgcgtcgtggttggtagttccacgtatgccttatcgccattcagatgaacgacaggcgtactgacgctccccacaataacaaagcgcggatcaacttccttcgattctgcgccaataaatgtacttagtggtccttgttgccaactagttgccacagtcgcgtcggcgtaatagcaatctcggatttcagggttatgccgggcacgaaataagcgctcacgggccactagttcactgattagtgccgtatcagttccgttactcattgacgatttcctccaatcattttagcaatcaccggccgacatttcgcgacgatcaatgacagcgctattcaaaaaccaatgacgatgccagtcgccacttaatgccataaatggcaccggcgtcttcccgcctgcttccaccttttcaatcaaataattacgtaagatccacggatcgttcaaagattgttgtgttaagtcaaataagtgatcgagcttagttgaactaatccctaaatcatcagctacctggactttcgtaagaccagtcaacgcaaagttagcttgtaattcatcccgggttgcctgcatttgttgtgcgtttaatgacattatttcgttcctcctataatttaaataacgtggttgccgtgccaaacgcgatttgagcccgttgttcatcggtcaagtcggcgatatccaggaaacttccactcgtctccggctgcttatacggataatcgatcgaatacatcaggtgatccgcccccatctccgctaacataaattgcaactgaggcgcactcaaaataccacttggcgtcacgtacacattatgccaataataagtactaaacggatattgcaagtctgtatatgttgttaactcatcatccaaacgttccaaaaatagtgggactagttcgccccagtgtcctgaaatgagcttcaaaccaggcaacttatcaaaaataccactagcaatcatccgtatcacttgaatcccaacatccatatgccaaccataaccggcagatgataagatccccgtgacaacgtcagaccattggttactttcaaaataatgactcgttactgcttgcggaataaatgaggggtgaaaatacacggggacatcaagcgtcgcagctgcttcaaagattggtaagaagaatggctcatcaaaaaatttattctgataatttcccttcagcaacacaccccgtaatcccagcgtcgtcaccgctcggtttaattcagcgaccgcagcttgcggatcaccaactggtagaacggctaacccagcataacgatcaggataagctaccactgctttcgctaattcatcattagctaattgtgagagtggaactgcttgttccggcgataagttctgtggtgatgaattaccataagataacacctgcatatcaatgccatattgagccataaatgccagacgttcatgctgggtgtcttgcataattgcaggactcggtaaattgtcccgcatgtactggcgtagcgctggactaactgctggtaacacagcgttaccaacagcttgacgcattgcggcagtcacagctgccgattcaaaatgctcttcaacggtaattaatttcattagtccacaatctccttaattggtcagttatatctaactgtgacagctattatagacgctttcatatgctaaaaaagggacgttttgagacatatcgtaatctggtgtatcattaacatatgacaaaattaattatgaacaatcaattgcatattgatcagcgaactcatcaaactcatcgtaaattgattactgccctgcaagcgaattttaaggctcaaaagtccttcaacgagttgactgtcaaacaactttgtctggatgcccacgttggacgtgccaccttttatcgtcatcaccaggatattgaagatatcattgtgattgaatacttaattgccttacaacagttaggacacgcgttgaatgacttaacgaccacatcttacgcgaccattgctggtgcgatcgtcacgacgattcgtgcacatctgggcctccccttactcgtgtcatgggcccagtgtcgcgagcgggtcatcccattagaggttggctttgcccaacagctactaactagcttagccatccatcctaagcaacggcattttatggcaacctatctcggcaactgtcttcaccagttagcttggcaacttgcaaccacacagacaacactcagcaaaattgagacttaccggctatttattcaattaattcctaatgtcttacaagcaccaacgattccaaccgactagtccgtttagtgattaggatacacaccacgttagtttggccgcctactcctgatgctggcgaatgtcgtcattattcacacccgccgtttgcctttatttgacgctacccttaccaccatgtacgctaacaatatcaaacaatttatggaggaaatatgtcatgccaatcaatccaaatcgcgcccaagatgtctggaaggatgtcggtgaacacgttcaatttaccgttcttcaattaaatcggcaggatcagcaacaagaccgtgaagtctttcaagaatttgcagatcggtcacaagccatcattcgctcattacgcatccgggacgccaaacctgaaactggcacccaattaaaagttagcatcggcatcagtagtgccgcttgggattacttgtttcctggcgcacccaaacctaaagaattagaaacctacaccaccttaagtggacccaaatacaccatgccagcaacacccggcgacctcttcttccacattcgcgcaagcaacgaagcggtcgtctacgaatgccaaacgcagttccagcgggtcttagcgccaattacgaccgtcctcgatgagacgaaaggctttcgttacttcgagggccgggccatcattggctttatcgacggtacggaagcgccggccgtagaagatgccgctgattatgccttagttggtgacgaagatccccaattcatcaacggttcttacgcctttgcacagaaatggcaacatgatatgcccgtgtgggaacatatgcacaccgaggatcaggaaaaagccgtgggccgcgaaaaattcagcgacttcgagttagaagacgaagacaagtttaagaatgctcacaacgttgcttcaaaattggaaattgatggtgtcgaacaaaaaatcgttcggatgaatgtcccgtactccaatccagcagctggtaacacagggacgtacttcattggttatgcccgtcactggactgttaccaaaggcatgctgcaaaacatggtcgaccaaagtgactttttactaactttctcaactttactatccggacaagcgttcttcatcccatcacgtgacctgttcgctcaaattgcagatgatgatttttaagctattactagcgtactcgttttgacgttaagggcttcgattaggaacacgctgtcaaaaaaggcagtctcgattggtacttaatacataccgatcgagactgcctttatgttgttttaactttagtttaacggtttattcacgaacaatattgattatcattccttttcacggtaactggcaaccaacatctgctatagtagtaagtaaagcaactatcaggaggtatcatttatggcaaatcgctatttacataatgtccaaggtttgttcgacaccatcgcgccgaactatgatcggatgaataacatcatcagtctcggaacgcatcgtcattggcgcaagcaaacgatggcacaaatccatttagcgcctaacgcccatgttctcgacctctgttgtggtacgggtgattggacgatcgcgctggctaaagaattacaggcacccggtgaagtcatcggattagacttttcagccccaatgttaaaactggcacaacaaaaagtgacccagcaacaggttgccgatcgggtctggttgcgctgcggcaatgcgatgcatcttccgtttaaggacaacacctttgacctcgtcacgatcggcttcggactccgcaacttgcctgataaagcccaagctttaactgaaatttatcgcgtactaaaaccgggggctcgcttggtctgcttagagacgtctcaacccgatcagccattgattaaaccagtctggcagtggtatttcacaaaagtagtcccactattcgggcgcttattcgcccatcaatatcaggaatattcctatttacaggaaaccactcgtcactttgcaagctaccaacagttagcaacgatgtttcagcaagcaggctttcaaaatgttcacttccaacggttcaactttggggccgcagcggctcactttgggactaaggaggccaagtaattggacgaactgaccgctttcaatcaatgtctggcttggttgacacacaccaccgccttgcctgagcacctcgatggcctggtcctttgtggcaacagcctcccagcaacagccactgcagcgggccagttagcccaagactatcaattaccactactcattattgcgggcggcatcggccacgccactaagtatttgtggcaaaacttaaacctgccaaaatctcaagctagtgaggctgagttgatggcgacgcttgttcgaaagactggctatcaaggtagtatccgcctcgacaagacttctaccaatactggtagcaatgccacgcatgcccgcgcgttagcccccaccgattggcgccacgtcctactcgtacaagacccgttactcgcgcggcggactaccctaacgttctcagccaattggcccaatgccaactttattcgctatgcgccggcgaccttgcaattaaaccggctacaaccaatgcaatttacgccaaacacaatattagctggctggcaacccgcttactttactgaactcttactcggcgaatttcaacgcctagtggatacccccaacggttatggtccccgtggtcagggcttcatcgcccatgtggatattcccgaaaaggtgctcgctgcggcccggtatttacagtcgcaatcactacaccgccagcgttaacgtttatttttaaaatctagtagtgccaccaaaaaatcccgtttcactgcagcagaacattgctacagtaaaacgggatttttataagatgggttgatcacgatttaaaaacgtctggatactgtgtccgcaacgcttgtgctgttaattcgcccgccatccgggagccagctaaatctaaatgcaccccgtccgtggtactgagttgccaagtagccgtttcaatgagttgcaattgcataaattcggccacgaccgcgcgaataatcgctgcaaaattctgattaaacgggatcattacagcaagccggctattcgggtaaagcgtctgcacctgattaaggaagcggcgcaaaactaccgtgaacgtcgtatcatccgtatgccgatcattagtaccaacattaatcacaactaaatccgtgggtactggttgccacgtcgttttactatccacggctgttaaaacctccggcagtaccggtacgccaccagttcctggtttactgagaccaacggcactataagcaatgcggacattccgtgcattcaacaagtcactcgcaaccgccgcatagttggcttccgcgcgataatcttcggcagggtacttacccatgacccagcagccggccgtcagtgaatccccaatccacgtcacactgtgtcggcctaaccgaactggctgtaactcaccatctgtcgtcagggctttcactgcaaaaccttgattgccatcccacacacggtcctcatcagtattaccactcaaaactacccgtaccacgtgaggccgaccatccagtgtcaaccatagggggtcattcgtcaccgcctgccgttgaaaaggcaagccatcaatctgaatcgccacccaactcggtagctcatacgccaacggcaagaatgtcaaccgcacaaaactagcatcagtgacttgaaaatcgatttcagcacccaaattagtgctatacatcacgtctcgatccgcaatttgcttgaccgcccaacgcccctgaaagtatgccggcatcaagggttgattggcctgcgttatttgataatccacgttttttccctcctatacctcttgtttactcaaacttgatcatcctacctattcttccgttaacttgtcatgaaacatgattaaaacatgccattttttaaattcaaaagcagccagcttagacccactggaaacagttcgggttagcgtaaacctgcttagttcgttcgtcctacgccgacctccaggcatttctgccaattgccggaacgtggtgggcacagatttgagccgaaaaaacacgtcttaaatactggcctttcactaaccaagcaaaggacgcttgctaagtgaaatttcaccactgggcattgtcagaaacgccttccagtcgggacagtattcgaatggcagacggagatgtacccaacttttattggactcatcatttttctttataaacagtaattttgtcgagcaactgtcaggtagaaggtaacattttgatagctcactatttcgaaatcactatagtaataatcgaacgtctcgacaaagtggttaatgtaaccttaaagtctcgtttaaaattccattatcaaaatagtcaacgaccaattgtaccaagttaagtggccgttcatctgccattcgagcggcttcccgactggaggggctggatggcaatgctcagtagccaaattattcttagtcggaagtgcctttcttccggcttagaataagactcgtatttgagatgacgcggtttgtgcgttagctcaaatcgacgtcggctgcgttccagcaattgtcatccagccccggaggtcggaatagaacgctcaccggctgacgaacagtaagccaactaaatggcatgttttaatcataatcactgccagcaatccagaattaatactgttattttgcaaaacttgacgcctatcaagttgccatcaagctgaactcactatactagggtcatcaaatcaaataaggagttgcaaattatgaaattccaattatttctcactaaacatacgaatcaaattacattagttacggggattctgattgtccttgggatgctcagtaaatatctcttacaatttacgctcggttaccaagtcattctagcagttgcttcaattattgccgtcattccgattgcggttcgtgcttggagcgcacttcggaacaaagttttcagtattgaactgttagttagtatcgcagtgattggggcattcattattggtgaattcaacgaatccgcaatcgttactttcctcttcttgtttggctcctatctcgaaagcaagaccttgcagaagacgcggaccgcaatcaaaggcttgactgacatgtcaccaactaccgcaactttagttactgatgatggcaccgaagaagtcgacgttgatgatgtggacgaaggtgacgttgtcctagttaaaactgggagtcaggttcccgttgacgggattgttgttgaaggtaacggctaccttaacgaagcctcaattacgggtgaagcacgccaaatcaacaagcaactcaaggactcggtttactccggaacaatggttgaaaatggctatctgaagatcaaagcgactcaggttggcgacgacacgacttttgccaaaattattgaattggttgaagaagctcaagataccaagtccaaagctgaaaagttcatcgaccgctttgctcaatattatacgcctgccgtcctcgttttagcagtcttagtcttcgccttctcccgtgacttccgcttagcaatcacggtactggttctcggttgcccaggtgccttagttatcggcgccccagtgtcaaacgttgccggaatcgggaatggtgccaagcgcggcatcctgatcaagggtggtgaagtcgtcgatacttttgccaaagtcgataccctggtcttcgataagaccggtactttaacggaaggtaacactgccgttacaaccatgcacacttacacaaacaacgcggataatcaactagctctcgctgccgctattgagggcgtttccgaccatccgttaggccaagcaatcgtcagttatgccgaccagcagtcagcgggggtctctcccgtcctagatgacactgaaaccgttaagggtcaaggaatctgtgcacaagtcggtcaacaagaagttgtcattggtaatcaaaaaatgttgacggctcataatatcaaactaaatcctacccaactcaaagatctcaatggtttacaagctggtggtcaatcaaccgttatcatggcagtcgacggacaagttcaactcatcttcgggattgccgatacgattcgtccaggcgtgaaggattccctcgccgcattaaaagcccaaggaatcaagaaactcgttatgttaactggggacaatgaactcaccgctcaagccgttgccaacgaattgaacctagatgaagttcacgccaacctcttaccagaagaaaaagtcgaatacgttaagaaactaaaagcagccggtaacacggtcgcctttattggagatggcatcaacgacagtccttcaatcgctaacgccgatatcggaatcgcaatgggtagtgggactgacgttgccatcgacacatccgatgtcgtcttgatgcaatcaagcttccccgcattagtacacgcccacggtctcgccaagaagactgtcttgaacactcgtgaaaacatcttcatcgccattgccaccgtggccttcctactgattgggctaatcttcggttatatctacatggccagtgggatgtttgtccatgaagctagtatcttagtcgttatcttcaacgctatgcggttaatcaatttccaaaccaagttcgacaaacaccaaccaactaaaaccattcaagcagccacagcttaatcaagtctccccaacttggttacaggcctagcaaccaataacggtccgccgactagtcttccccagctagtcggcggaccgttttatcatattgcaatcaaaaatgatagaccaataataatttcataaatacgctcggttaattaattgcgattataaaccaaaaaagatcttataaatccaaattccaataacggcaccaacaattggggcaaccacgggaacccaactatattcccagtgagaactacccttgttcggtactggtaataacgcgtgtactagccgtggtcccaagtcacgggccggatttagggccggaccggttggacctcctaacgaaataaccatggcagcaatcaaaagtccaacgccaatattggcgatatcgatattttgatggaaaaacatcccgtgatatagccccatggcgccaaaaatcaggaccgcggttccaaccatttccgtaacaaaaccgtttaactgactgttcgcatgatcactagttgcaaacgtccctaagactgcctcattatcagtcgtttgccgataatggggccagtacagtgccaaaatcaagcattggcctgcaattgctcctagaaattgccagattaagtaaggcgcaacgtgcgcccagggaaagattccaatcacggcttgcccaatcgtaatcgcggggtttaaatggttaccagaaatcgagccaaacatcatggctgggagcatgacccccagtccatatcccgatgcaaccaggagccatcctccattggcgagtcctggatcatcgttaccagtcgtgttcttcaggaatgcgttagcgacagcgccattacctagtagtactaggatcagcgtgccaaaaaattcagcggcgtagcgtgcttcccatgaacctgtcatctgtaaatcctcctcgtaaggtaccgagcatctatgataatttgaagataccagataaaactgtttatgtaaacgctttatttcgcttaaataagcggtttctaataattcaacataattctaccagataccctgggttgtataattatgaagcgctagtataacacgctcgcgtcaacatgagatcttcaacgttaatgctcgcgatcacaactagaagattctcaggtgacgctagcttccacaacaaatcgttattatctaattacccaatacatcagtcctttttaaatccctccacggccagaagcagaatacttgctcgtgtatacctatgggggtatattgtttagtgacaaatacttactaaaggagtcaactaaaatgattaaagaaatacatgaccaagattttgccaaagaaacagatactggtatcgccgttattgattttcgcgcagactggtgcccaccatgtcgcatgatggacccaattcttaagtccctttctgaagacccagcttacaaggaccaggtcaacttcgtttcattgaatattgaccatgaccaagctacggccagtcaattccaagttcaaggaattccaaccttcctgattaagaaagatggccaagtcgtcagtcacatggtcggagcacgtcctaagcctgattttgaagccgaactcaaaaaagcacttgcttaattacgaagggggcatcatgaatcatggcaactactgaagaatatgtcactagcaagcagatcaagacccggctaaaacgctcggctggtcaactggacggcgttttgcgtatgatggacgaaaatcgtccttgcgaagatgtcttggttcagctttcagcagtgaaatcaagtatcgacaaggccatgaaactcgtcatcgcccgtaatattaataattgtgtagatgcgatgaccacggctgatgttcagaatcttgaacactccttggatctactgctaaaaaccaaataacgccaaaaaagacggtgtcgcaatctcagttggttataccgtctttttagtgccagttgactcagttaagcaccgtatctgtcaggcaacttatcgagtcaatctttccaatctccctttttccagtcatcatggttccaatcatcttttttccagtcatcgtcgtcatcactgtgggactgctcggcatccttgggcgctcgttttgctcgcttcaacagtaccgccgttgaaatcaccgttacgaacccagtcgcaataataaagacaaatgtccacatcacaatgtcgctaatcgccatctcggggccctcccatataatttaattgtcgttagtatagcgcaggcccgttgtaatagcaaaaacgccctggatagtttgcccacacaatcgctatccagagcgtttaattcttcagcgacaacgacctaatcgtcgtcatcctcatcttcttcatccaaaccagttcgagcatcgttaccaagataagcttgtaattcccgaatattgcgattgttactgccacgataagcaactaaccaagctgccagtgccggccggttttctttttcagcaagcttgatagcccggtcaacgaataggttttccgtatcaaaatccttgattgttgcggccacgagttcatcaacagattgatacttgaaagccccattttcttccaacatggaatacttggttaattcagccgttgtggaagatggcttctggttttcatctaggagtaattcgcctaattcagcaaactgacggacattctgatctaacaaacgttgatatgctgtccgcaatgccaatgattgtggtcctttaacgtaccacttcacttgggtcaacttaacgtaagcaaccattaagttagataaaatgtgattcgtcattgcgcccgctgttgggacatggtgatcaatgtcactctgttttaattccgctgcgtattgttcgtcgatcgttagttcactcatcgtttattcctcctacttaaccttgacgttttcaacttcgtaaccaagtccggtaacaacttgtgccaaatcatcggcattcgtcacttcaggatcaaagttagccttgaccttgctggcattgaatagcaccttaacattctcaacgccgtcatggttagcaacggccttttcgatcttggtcatgcatgatgggcaagtcaacgttcctaattgcataataattttcataatcaattacctccgtgtcgttcatttgatggttctatcataaccggatttgattgaccagaacttgacggccgtcaagaaattcaaaaaagttttacgctacaatatagttattaaaacagtaggaaatttaaaacgtcaaaccctatctaccaagcaaaatctgttatagttagggtgaatttattcaggaggtgggccttatggcagaacatgaatgtgtgcagttagtcccaatttttagcgaactcggtagtgaacaattagacactatcgaatcgatcgttcgtcaccaccactatccagccggcagcactttatttggtgctgacgatccactggattcactgatgattgttgccaatgggcaggttaaagtctatcagctagctgccaatggtcgcgagcagttactatacctattacaaactggtgatatcgatggcgaagctgccttatttgaaaatcaacggcgaacctcattcggtgaagccttagtaccgacggatgtttgcagtattcgccgttcagactttcaagacttgatgcaaaaatatcccagtatcagcatcaacgtcttaaacgtctttggcaaacgtctcagtcaactggaacgtcaaacaaccagcacggccactgaatccgtcgaagcccgtttagcgaactatatcactgaaacagcggcagcgctcaaaaccgacacgtttaaactaccattaaagaaaaaggacctggcgacgttcctcggcaccacccctgaaagcatcagccgtaagctcgccttattcgagcgtcaaggcctaattacgcaaaagcctggcaaggtcatcgaaattaacgatgccgaccagctattattaactgaataatgactactaattaaattatccctaattccccggatgactagcgaaatcaccgttagtcatccggggaattttacgtcaaccatcacactgcctcataaggtgatttacaggcactaacagctcctgcatgccgataattcagaagtaatctcgccctttacattaacattcacaacccatccgctactgattcgggactattaagatgattagtatcattttttactgagtcggtaccagatgataccactgagaataatctaaggtataattaacttagtattagaaaatttattagggagtggatttaatggcaaccattaatcaagcagcagtaaaacaagatctctacgatgccgtcaacggcgagtggctcaaaaccgccgtcattccggatgaccattcttcaaccgggggctttatggacttagttgatgccattgaaaaaacgttaatgcatgactttgatgcaatggcggcgggaacaattacccccgacgatcctcagctaaccgaattcattaagttttaccgcttagctaaagatttcgaccaacgcaatgccaatggtgcggaaccaattctgccgtgtctcaagcaaattgatagtttaagcgactttgctgacttacaacaacggatgcccgattggatctacgacggcctcccattaccattcagcttggatgtcgacgctgatatgaaaaataccaaggtcaacgccttatttgcccaagcacctgggactatcttgcccgacaagacatactacgacgaaggcaaccaggccggccctaagttactagcaatttacgctaaaatgatgaccgaactgttgcaaaaaactggttacgaaaaggacgaagcacaaaaaatcgttgatgacacgctgcaattcgatcgtttgatcgttccatggatcaaatccgctgaagagtcggctgattacagtaagatgtataatcctcgcaaattcaacgattttgttaacactagtcgttatttagacttagccgccatcacctactccgtcatcgatggtaatcccgacctcgtcatcttgccagaacccgccttcttcgatcactttaacgaagtagtcaatcctgataacttcggtctgatgaagaactggatgaaagctaaactcgttcaacggtacagtggttacctcagtgatgaaatgcgggtattagccacgacttattcacgggcattgtctggtcaaaaagaaccgcggaaccaggctaagagtgcctactatctagctaccggaacttttgatcaagtcgttggactctattacggccacaagtattttggtgaagcggccaaagcggacgttcatcagatggtcgaaaagatgattgccgtctacaaacgccgattgcaagcgaacacttggctcagtgcagatacgcgtgctaaagccgtgaccaagcttgataaactcggcattcaagtcggttaccctgataaactagaaacgatttacacaaaattcaagacgcacacgcccgaacaaggtggcaacgtattgagcaatgtcctccactttaaccgtttggcacgccaagacatgttctcaaagtggggcaaagccactgatcggacccgttgggaaatgagtgcggacaccgtcaatgcttactaccacccatttatgaacattattgtctttccagctgctatcctacaagcacctttctacagcttagaacaatcttctagcgctaactatggtggtattggtgcagttattgctcatgaaatctcgcacgcttttgacaacaatggtgccctatttgatgaattcggtaacttgcataattggtggaccgaggaagattctgcccacttcaaggaacttgccaagtccatgatcagtgaattcgatggcttggactttgctggtgcgaaagttaacgggacgttgaccgtatccgaaaacatcgccgatgcgggaggcttaagttgcgcggaagaagctgctaagggcgaagatgacgttgatttgagtgcgttcttcactaactgggccatggtttggcgtatgaaggccacgactgaatacatgcaactcttactttcaatcgacgtccacgctccagctaagctccgagcaaacgtacaatctaagaacttagatgatttctacacaaccttcgacattcaacccgatgatgccatgtatttggcaccagataagcgggtcaaaatctggtaaaaagctttaatcaatgaacactaagaccgactaacaagcggtgcgattgcttgttagtcggtcttttatctgttccatcattatgggtcttattcattcaaattacgcgttagtatattacaatagaactgttgtctgatgccgttacatcgttattggactgtgacccagtctcaatcacgactgcaccgcaaatcacaccagcagacgcgttattagtcgacctaacgccattttcagcgggggtcatcaacaaggcaatcccagtccacttgacgcttaaatcagcatatttggacactggtaaccatcgaaaacaactagcattaactatgattaaaacgtgccatttagttggcttactgttcgtcagccggtgagtgtcctattccgacctccggggctgggtgacaattgctggaacgtaagccgacgtcgatttgagctaacgcccagcccgcgtcatctcaaatacgagtcttattctaagccggaagcaacccacttccgactaagaataatttggctactgagcattgtcacccaacccctccggtcggtaagccgctcgaatggcagatgaacggccacttaacttggtacaatttgtcgttggctattttgatattggaactttaggtgaaatatcagagtgccttcttcactttgccaaaacgttcagttgttactacggcgattcagaataacgagctatcacaatatcatttttagcctaacagttgattgacaaaattactgtttataagaaacaacgacaaagccatcaaaaactgagtacgcacatgtccgccattcgaatactgtcccgactggaaggcgtttcggccaatgctcagcactgcaagagtgtgaggttcagacggggtgagactgaggattagcctagctagggcgttaagcggtgaatttccgcttgacgtcatagcatagctaaccggaagtctcagtctgacccgagcacgtttcaccaatatggcattaaagcgtggaagaccagtatttaagacgtggtcttcggcttaaatctgtgtccactgcgttccaacaattggcagaaatgcctggaagtcggcgtaggacgaactaactaagcaagtttacgctaactcgaactgtttccagcgaacctaagctggctgattttgaactcaaaaaatggcacgttttaatcatgattcataacagtttaactagtacaataggaattactaaatattcatgacgcattttaaaggaggcactatgtcacaatttgaaaagtatcatcccattctaacgccacactatacgttcgattggttaacaaaggtgcgcgttatcgacgttttcaacttatatcagaccagcaatgcgacagccactatggaaacaaccgctgcacaaattaaccacaccatgcgcgagatttttcatgaccaccagcttgtttggggcgtaacggatcgagacacgaatgcgttcgtcggtcaggtcggctttgctccaatcgatacggctaagcatgaagcaactctcagtgttgacctgactgctacttatcagcaagtaactacgctcagggaaatcttagaacggttggtggcatttggtaccgttgagttaaagttgaaccgactcacattgattttaccaaagcacgatgacctaatggcacaaatactggctggccttaactttagtaccaccgaccacttaacattcaattatcaccaataaacaaataacgcgatgctaccttcatgaagcaaggtaagcatcgcgttattttaacttattattcagtgacagcttcggccgcatgggcaatcgctgcttgaccaagtaagttcaaatagttaaatggccggtcgtaaattggttggaagaacatatctacgaaccctaagtcgtcaatggtattgtgattttgaatcatcactgaaatcacattggctgattgcgaaacatcatgttcactcatgaattgtgcacctaggatttcgcgagtttcaggattgtaaaccaattgcattaaaacaggcttagtggttggcataaattctggccggtagttgtcttcaaaagtgacagcggctgccggaacattttcggcctgtgcatgttctagggtcatcccagatgaaacgatggtttggccgaacaacattaacccagaagttgattgtgtccccatgtacttccgcgttggcttgaagatgttcaaaccaactaaggttccttggcgaaccgcattcgttgctaatgggatataagcatctttcttagttgggttatagtgaacagcaaccgagtcaccagccccgtaaatgtctggatcagaagtttgcatgtagtcattggtcttgatcgagccattagcgttcatatcgaccttgcccttgagtaagccggtatttggccgaaagccaacacaaagaatcgccatgtcggctgtgtagctgcccttgtcagtcttgaccgtaacttctttaccatcatcactgaagccttgcaccatttgattcaaagccatcttgataccgtgatcaacaaagtcttgttcaacccggtcggtgaattctttgtctaagtatttatttaaaatccgtggtaaaccatcaattagtgtgacttccttaccttgcttctggtaagcttcaactaattcagtaccgatataaccgccaccgatcacaatgacccgcttagctggtttggctgcttcccataaattctgagcgtgcatccagttcttgcataagtagacattgggactatcgatgccgtcaattggtggaataacaggccatgaaccagtagtgacaactaacttgtcatagtgatcagtcttagattcaccagtctttaagtcagtaaccgtaatttcatgtttgtcagtattcacatccgtcacatcatgttgcatatgaacagttgcgcctaacttagctaactgttcaggactggaataaaataggccttgaggatcagcaacttggccgccaaggtaaagtgcgatcccacaggataggaacgagacattgtcatttctttcataaatcgtcacttcagtatctggatttgatgctaaaatctgattaacggcagcagtgccggcatgggtacaaccaattacaataactttcatttttaaatcgctccttaaatgtgtttatattcacaatcatgcttgtgcaacatgtatttggtaacaattacattgtactaaagtaaaaagaaaacgcaaccaaaaacacgtaaaaagtgtaaatacttcactaatcacacgataaacaaacgccttgattacaacgttctcagtcattcaggctgattattcattcacttaactgtggtaattaaaattattattatctttaaccattatggctaataactagaaagcaaaagcactcacaatcttgcgtgtgagtgcttttgattctcttataccaacccgatcattacttaggtgcatctgttaacgtccacgtaatatcccccgtgtaagaacccggagtagctcccgcattgctttgatataaaatgcctgacttattcgtccagtctgccaagacatcataatcatcgttatcactagtagccgtgtgactgtcaatcaccgtacccgcagaattcagcgtggtcgtctgctcgccgtcgcggaaaatcacgtcgcccgccaaattctgaccaccggttgttttaaaattagtcgcactagcttgtagttgccaactagagcccttaccacgactatcccgtacaactagttgccaatcgtcttcccggtctgtcgtttgagccgaaccatctaaagtaatggttttaaacgtgctgcttttggcaaccgtcttaaaaccaagttcacctgcagtaacaataatctgcgctttatcaactggtgagacgttctcgtaacggtcagatgcccatagttcaatctcattgtcatcgccgacgtgtaaatcctctgctttgaccttgtagtagaagtaaccttgttcgtcatcatccgacatttgaaccgttggcatttccttgtcattaagcgttgggtgtagtgtcacttgaccgttatttaattgttccgaatcctcggctgcaacaatccctctgatgatcacgtcttccccattggcgacagtatacggactattacgaattttaaggtatagcggctgatcgactgtaatcatgtaatccggtgcttccgtcgttgtttcaaacaccttatttttaaatgtcgccgtcgttgcagttgtctgttcattgacaacgacattctcggccgtcccattgagcgtgatcgtcgcggtcggttgactagccgatactgctttatctagagtatagtcaactttagtatcactactcgttggcgccgtcaaagtctgctcactaccatccgcatacgttaccttggcactgtcaaacgtaatatgctgtggtagattgagttcagccgtaatgttatcccagtcaatttgaccaccttggtaagtcaattgatagtcgtactgaactttatgctgagctttgagctggccgcctgtcttgatttcacgattcttggtcttatccgtaaccttaaccgccgcctgtacgtcaactaaattcggcgcgctttcaatcacgaccatgttattaccagaattactaccagtcgcccccatgaatccccagcgaaccaggccatcactactgttgaattggctagtatctaacacttcactctgagtaaagccgctacccgtcgccgacccatctggattgatgtcattataagtgtacgtcatcgttttagtcgccgcatgccagtccatcaccaggtggtgccacttgctatctcctaatgacatattcgtcactaggttggtatgtttttgcgtaaagtagtaccgggttgaccaaattatcccggtaacgtctaaactcctgacagactgattttcatactgactagccagcccaggatacccggtcgcaatgtgttgtttcttaataccatcatcaaacgaatcacccttaccagcattactatagctagttgaagtattggtataggtatcaaactctaaggcccaactattttggatggccgttttcgcaaattcttcgccgtccttcaatttattatccgtatcaacaccccaaacaccgagtgtctcaccaataatgctggacgaactgacttgtgcggatgcggcagtaccatttggatcattttgtaagacaaaagccatcccatcgccggccttactagtactcgtggatgttcccaaatacacccacattttaaacgtagcatctttatttaaatctaggcgattggcgtcgttcgaccaaaagccacccacttgcttcttgccgttaataacctgaacggcctgcgtatttggcgagcttgcattggtcacattcccaatattcgcactattactaatgccactactgaatgccgctggtagcgtaaagagtttatccaactgattcaggccagacggtgccgttgccaacgtcgcttcgtcagcagcctgaatttgggcggtcccggcccataatcccattaatgcagttaatgcaactagtatttgtttcggtcccttccacaagttgaaaactcctctcgctagttagtcctgacgacggcggtttttcaatagtagccagataattgcgcctaataggacaacaatcagtgcgcccaacgcaacaaaccaccagaaatagctcgattgtttttctgtaacagctgtatcatttaaagtctgagcttctttatcagtaatggtaaagttctttgtaaattgccacttacccttatcagccgttgccgttaaatgtaaagtgtacttgcccgccttcaattgttgcgtcccgtcaccaactgcaaagtcaaaattactattcggcgccattgacatgttttccttagtcgtcgtcaataattttttagacgaaccagctttagtcacgtagcttttgatctttaagccatgcataataacgggctggttgttttgcagattagccgtaacgtaattacgatagttacgttgcttgacttttactgcgtgcaacttcatcacaggtttgattccgcttggatcagattcacgtaactgcaagccaatcacgtacgcatattgattattgatggccatgccactactagattgtttcgccttggtactgagttcctggatgatattgattccacccagcgccacgcccgcaaactttttctcgggtaccgtcaatttaatagtgacttttttgcttgacttagcgggaacggtcacgacctgtgactttgaaagtgctgtcttgatgttaaacttcaaggagtcatcggccttagcctttgcttggctgtaatcgatgataccgttattatttgtaaccgccagattaggtgataccgtgtatcgatgttctttactatcactatttttaatggttaaagtgagattttgcgtttgccctggtgtgaccttcaagtcaaaataggacactttttgattaatttggttatcaggcaaatcagcctggaccgtgtaattgaggtcatccgctctagcagtcattgtcaaacctgccataacgatgctcacaacggcaattaactgccaaaatatttttttcataggctttacccttcctttattcaacggtaagtgacgagctatgtatgattgaagctgccattctttacaagtagcagcttcacatcaaaccatttaattaactaggtgcgttcgttaatgaccaagccagcgtacccgtgtagtcgccagcacgcaattggcgatcatggacttcaagttccgtgggtacctgcccgcgattcagaacgaccagccaagtacctagaccagtattaggcggggcaatcacgacattattcgctaaaccagcaactaattcaccagtattaacaacgttaggtgcagtactaacattgccagcaccgggccgtaattggactgcgcctaattttaaagacgtcgttaaggtctgctgaccactttgcaacccgcttggcgtgacctgtaacgtccatccagcagccgtggcgcggcgatcagttatttgaatcatcgcccgctcattcttggcagtcgtcttaaacggcccacccgcggtcgtaattgcattgaatttcaaattactgacgaaatcaatggttaactttccccgtgagcccgtaccagcgacattgtcttcatcgaccgggtcacccgggtatggtttactgggatcatcagggtcgaccggagaaactgcattgtcatcatccgagggggtcatttctacctgcacctgtgactgtgtcgttgcagcttgcgttgcgataaaccagccccagttactaatgatgagacaacctatcacagtcattaataaccgacctgttaccaacaatccctttttcatcggtcacacctcagttctcctctggcgcattaactggttagctaggggcgttacctaatgtccatgtcaaggttgaagtgtaagcgccagccgcgttaccagcagggatcaacaggctaacttcattggttgcatacttactcgtaaacttaccgatcccttcattagcttctgcgtccatgataatttgattttggtcagtgatatccactttataagcttttactttagagatgttattagcatcatccgcagttgcattaacttgtgcaaaagttaacgcggcgccccgtaattcacgagtatcatctgcattcatgaacttcgaacctttaacttgtactaaccatccgtccgtattcccagggttggtcactttcaagtcgccagtaacgttcttagcatcataggttttactgtcattagtgattttttcggtcccaaagctaacaccaggtgcttgatccaaggtaatatctttattagtgtcatcctggattaattcaacttcagctttggtcgttgtctccgtatctgcagcttggccaacaagtggtaatcctgccattagtgtcatgcctgcaacgagagttccgagatattttttcattttggttgctcctttattgtttgacggttgcgccaccagattagaattaataatattaataaactaagtccacatacgccgataccgaacagaatccattgctgggtcccattcatttgcggtaatacaccttgtagcgggctcgcaattttatcggccgccgcattgccacctgaattagaagtgatcgttaagtggtaagtgcctgattgcgtatcagctactagtggtaacttgactagctgactaatacctaagtcttgaaagctgcccatccaattaatatgaccacatcctttccagatattgacttaagcttagtatcattattaacgcttagtaccaatagtgaatcgttgtgagtaaccctatcagcaacgaaaatatatcatggttttggaatcgctgtcaattgatgacaccccttaactattgattaaaattcctattttaacggacttctgagccatttttaatattatagtgattacaaatattttaatataaactactgtaatcagtttaacggcaagctttcctactgctttcatttatccgattaggtccaactagttggcgtgttcaactaaacaagccgtcaacattatattatcgttagactttgatgaggccacacataagttaaaaattttgataattataaatattgaaatcctatatatatttagaatatcgttgtaacagcaagctattacataaattatcttcaatttataaaattatgtaatcgatttaatgtggaaatcttttatcaattttaaagtgcaacacaatcaactaattaaaatcggctttaaaaacagtaaaagccccctaatcaaataatttcaaacgttaatattcatttaccaaacaatgaagtgtgctgtggtatacttaaaacacttatttttaaccagaaaggcggttcgaatcatgcccgctaaaaagacatttcaagacgatcaagttatcgaaaaaatcatgcacttattttggcagcaaggctattatcatacttccatggacgaaatcgtaataactagtggcgtcaagaagcaaagtttatataacgctatcggggacaagcacacactttacctgcgtgcactccagcgctatcaccaacaaactttaatgcgttgtacccaagcaatgcaacgcttagagcaggatggtgccgcccccttagctatcctgagtatgctctttagccacgatttaacgacatccgaacaaacagccggtgacctaatggctaacgccgtcgctgaatttggtactactgatactgatgttcagcaagccgtcagctggttttatgacgactacctgaccctcatggctgcggtcatcctcaaaggtcaagctaacgagcaaattatcaataatcagtccagtatgacattagctcaggcactgctagaagcccgcattggccttcaaacgcgactccgtcaaggcagtcagccagatattcaagcgcagcaacaagcctggatggcttttctagcacgtcgttgaacctaaagcagttaatcagcgcataaaataagcaagcttctcccgaacattttgggaaaagcttgctttattttttcatctatatataagtcacagtcatacttttgggtcataactagcgattgacttataaatatttttgcactaaccagtgctgtgctgagctcgtcaattgactaccataatgttgtcgcaaccgttgcacacccgcgtaatggtcaaattcaaattgacttgtcagcgtctcactagctagcaacgccttagcaaactgtaaatcgtcaatcgtaatctgttgtcggtaagccaaatcttcatcggctatgattcgttgccactgatccgttaagatggcactggcccgctgataacgacggtcatgggtcaacaaggattgcatatcatctggattaagtggtgtccccatattattcatcctccaagttcaaattaactacatgaccgattgctggctcaatcgacaatcgatcttcagcccgcgctaacaaccaaatcacatttgtaaaacggtgtgactcgacgtgccgttcaccacggccatccgttaagatcagcgccaaggtcgtcgcattcgtcttatgatgtgttagtaaatcatcaaaaatactttgataaacggttccaccaccgccacggcgcgtaaagcgaatctgctgtggcaaactcacctgatacgtttgaccaggctgtacgattgcatcaaacggcttaacggtgatggttgctgcaaataatcgggttaaagtagccacctgtgccagtaatcgttgcagcatcagatcactgatagaacctgaattatcaacataaacttgcaagtccaagcgcgtatcgccaatttgaccgggtatttccatccgcgcgggttgccgtcgattaaagcgcgcgtgcgaggccttagtaccgctcggaatctgacccaggccccgaactagtaattgtcgccaatcaagctgggccggctgcgtcattacagtgagctgagctcgaacattgccggccactaaccctcggccagcttcatttgtttgctgccaagcatctttcgccaactgttttaaacgggcagttgccaaattgggattcgttaactgttcagaggctgaccagccacttggatcatcgatcaactgttgcgacttttggtcgccagacccttttgctggctgccgctggtccttatttcgcgaagtggcggtgggcgcgccattcggctgaagttgcgaccgcgactgctgctgtaataatttcaaataacagccagaatctgctcgtcgcggtagctgggcatcgactaacggctggacagtcgttaaactgaccgcatctttaggcagaccgtcgacatactggttaacggccaggtcggtcgccaacgtcactaactccggttgctgcttgacctgatcacgataccgaacggggtgttgccagacaatgtgtagtgccacgtgttttaaccccgcttgtaagtaagaaaactgtgaaaaagctcgagcaattactgttggcgcatattgtaagaccaactgattattctgccaagctaagataaacggcgtcgttaacgtcgtatttaactgtctgggaagtcgggtcagcaactcgccataaaattgatcggtggctagtaactcaataatggcccgatcaatcatggtcgcacctgcctggatcgtgtctgctgttggcgtcactaacatcgcttgttgccaacgtgtgtactcattggcattgttaatcatgatgactcactgctttcttactgatttgaccaactggcgacctgttgtaaatactgatacaaagcggtcacatacggactttgcttggcaacatttgctgtatataattgctttaataagtcgcgttcatggccgatttgttgaaccaatgcaaactgaccatcttgactgagtgtttgtaggagttgcatgaaccgaccagcgtgctgatcgtccgtcaacggatacgtggttgttagagccaaacagcttgccaaaaccgttcgcttttgaatttcattcatcgccgtaaactgcttaagaatcggtgccggcaccacggcccccactggttgactgtcataaatcatcgctggtgtcagatgaatggcttgttgttccaagaattgctcgaatacaagccctagctcagtacccacatctccttgaaagatatccagtgccacagccgtttgttgatgcacaggaagtttttcaatctcatataaattagccgaaacacgcgcccacgcacgtggcgtcgctgttaaatcagcctggacatcagcctgattaagccgcgttacatcttcactaataaactgctggacgagtggatgaatgtttggtcggttcatgtgctcatccacttgtttggcccaagcaagccagtctgccgcatctgctcgcataactagacgcacggtacgatctttgatggccgcatcgccggcagtaacgccatacgtactactttcgaatccagtcatactagcatctggattttcagcaatgatcaattgcacctgttctggcaatttcaatgtgttaatcgtccgttgcaagaccagattcatcaattcactttgaacagcctgcgtcccacgattaaattcgtctaaaaaccacagaattggctgctgaggatgctgctcagcatactgaataatttcaatcaacgtgtgtgcatagccgaattgcacgtcagccaactggccatagcgcttcgtttgaataaatgagtcgctcgttagtggtgggactgggatcgctaaatcccctttttcggacaggctcacaacggtcgtgtataattgcgcccccatccgcttagcaacctcggctaccaaggccgactttccaatcccggcttcaccgacaatgttcggtacgttccccgcttttaaaacgaccggaactgctgttaatagagcttgatatgataacgccattaattaaaccttcctttactgttccacgtgaaacaaatttaattcgttttcaaaaacatcagcttacttgtcctaaccattataaaacagaagccaccattatcgacaattagcgttcacagtcacgttagatcacacaccaatcatactgactactatcaatagtgactatgcaaaaataaaatttttatttattatagttttaacaatccacaactgccataaaacgtttttataccaacgttttaccagtatcttatcaattaatataattataaaaatcttatcagaaatattcacaaatcaaacaaattccgtcgttttcacgagcaggtattgtaaaataggttaagttagcaattattcaaaaagggagtgtgcaactatgcgcaagtatctcgccgaatttctcggcacatttatgttagttttcttagggactgcaaccgttgtgattgctaagggtgacgtcctcgctattgggttagccttcgggttagcgattaccgtttcggcctatgcctttggtggtatttctggtggtcactttaaccccgccgttacgactgcgatgttaatcaaccgtcgaatcgatgccgccgatgccattggctatatcatcgcccaaatcattggggccatcgttgcttccgcagcagttaagtcgtttgtcagtgcattaggcttatccgcaacatcgcttggtcaaaccgattttccaaaaatcggcagtggtatggccttctttgtagaagcactagtcacattcttattcttaatggttattctgaacgtcactagtaatgaccatggtaacgcagactttgctggtttgaccattggggtgaccttagcattcttgattattgtcgctctcaacttaacgggcggttctttgaaccctgcccgttcaatcggccccgctatttttgctggtggtagcgccttatcacatctatgggtctacatcttagcaccagaagtcggcgccatcttggccgcattctgtgctcgggttatgggatcagaagactagttagcaattgacagtcgtaccattaaccacgatcaatttgatactgaaacatgattaataaaacagcggtaccgtgatgattttatggcttggaatcatcacggtaccgctgtttttcgtatgcttatattttaggcagtctcaattagacgaatctacgttgccaacttctcatgacgcatggccctatagcctaaccctacgccaagttttacttgcgtcgccaatgcgtgtaccaggaatggagcgttccaatcaataggccaataatgacgacaactgctgaaacatagccaaaaataccaatgtttgtaatccaactattatcaggatggctttgaactagtagtgatgatccaacaatcagcgctgccagaataacggacagtacaatcttattgaccatcgaatcaatccgatcaataaacatcttgcggtgtgcaaagaccaagttgacccgcgtctgaccattctcaaacgtatctagagctgataataagcgtgacggaatcttcggggcatcacgcaggctttgaaggctagccaacatgccatcttccagttcattgcgccaattaaaattctcgcggatgtacttgcgcgcaaacggccgcgccacgtccatcattgataaggtcgggtcgagcgtctccacaataccttcgatcgttccaaacgccttacctaacatggtaaccgctggattcatttgaatattattactgcgacaaaccttgaccatttcaaacaacaagccttgaaaatcaatgtcgcccagtcccgaattataatactgacttaaaaatggtgctagctcactaaagaacgcttcttcatcaaccacgccagttcggtttgaaatcgctaagattgctttgccgacttgatgtgtatcttcggttgtcactgccacgacaacattagcaattcccgccatcaaagctggactgatctcacccatcatgccaaaatccagataaactaaacggtatggtggtagctgccgtttgccaatcttcccgccatgcttgggaaccgtatcgtgatacccaatatcatctggttgcaattcccgcaataagatattccctggatgaggatcagcgtgaaaaaagccatcttcaaaaacctgcttcaagaaattttgcaccaagacatgggccaaatagcggcgttcgtcatcatactggtgatttccgtcttcatcggccgcaagcatttgcgccataaaatgctgaatcgtcgttcccggcatatactggttaacaagcactttttgcgcactatacttcgcataaacccggggtacccgaataatatcgtccgcattattcaatcggtaaaaccgtaatccattttttacctcaatactggtatccaattcattgaatagtgaccgtttgatttcaccaaccatttcgcgcaaatcaacaactgaagattccggaatatatcgcaataggggtaacgcccgctcaaataatgaaatatctagggccacctcggcgtcaatacccggatgctgcaccttcaccacgaccttctgcccattgagcagcgtcgcatggtgcgtctggcccattgatgctgatgcaaacggtcgctcgtcaaactgggcaaacatttcattgattggctttcctgtctgctgctcgatcgtttgcttgaccacactaaaatcatcggcccggacattattttgcaattttttgaattcgttagcaaattctggcttaacgatatctgtacgtgaagaaagaatctggccaattttaataaacgtcggtccaagttcttcaaacgctgcgcgcacttgatcaggattcttctgacgtgcaagattgctcaaaacgttatagcgccgcaagacactgacaatcgtccgaaaacgggtatggcggttctgattcacttgccattggggctcttcctcattgttgttggtcatcagcggaccctcctcacaaatttccttattacagctattatccatctttatttaagaatccgcactagctaactaactttttttgaaaaaagattgacaaatactaatcgcggttgtaaattagaaccacattaaaaatcgattaacaaacacgccgatgaacaaagtaaaccttctggaaatgcctagagagtgtcagtttggtgcaatgacatcatgaccagatcgttgaaaatcagttctgagtggcagtgacgagcttgatgttagttgctgttggttgctcccattattgagccgaagtatcgcaagtggccggccacttgccgtactttttaaggtgattcgtcgtaaggcagtcacaaagctaaggtggtaacacgtgttcaaacgtcctggtttctgagtctaactcagatatcaggacgttttttggttaatcgcaacttttatttaatgattattgtctcaatcaaataagggagtgctgttgatatgttaaatcgagttcaaaagcgaaacttaaccaaacgtgattacgtcaccttaagttcaatgattttcgccttattcttcggggctggcaacctcatttttccacttcacttgggtcagctagcgggcggtcactgggggattgctgcggccggctttctcatcacggcggttttattgcccttactatcggttttagccgtctgtgtcactaaatctaagggcgtttatgacattggtaaaccactaggcgcaacctttgccgttgtcttcatggttctcatacactttacaattggccccttctttggaacaccacggacggccaccgtatcattcaccgttggtctggcaccgtttttcccagcaaagtatcaatcactcgcattactgctgttttccgccgcatttttcggactcgcctactacttgtccgttgaacagagcaaaattatggctcgggtcggcaaattattaaatccattatttttgctattattagtcgccatcttcgccgtagctttcagcagtccgctagctcatgccggtagcaccagtgcaactgctgcctatcagaccgcaggctttaccaatggtttcttgcaaggctacaacacgatggacgccttagctgggttggcgttaggcgtcactatcgtcactgccgttaacttcatgggtcaaaccgacccgaacaaagccgcgtgggtgaccgcccgagctggcttcttctcaatggcctttgaaggcttgatctacgtgctcttaatcttgttaggcgcgcaatcgttaggtcaatttaaattatccgataacggcggggtcgcctttgaccaaatcgttaaccactacatgggtagtgtcggacaagccattttagccgtgttgatcattaccacttgtttgaccaccgctatcgggctcgtcgccgccttcgctcaggacttccataagcacttcggtttcttgagttacaaagcctggttaagaatcacgtgcctcgcctcatttttaactgctaatgtgggcttaaatcagatcattgcctggtccacccccgtcctgatgttcctttacccgttagccatggcattaatcttcttatcgatcctttcaccactcttccaccagtcaagtgtcgtctatgtttgggtcgtcgtcttcaccgtcgtccccgccgtctttgatatggttgccgctttccccgccgtcgttagccaaagtactttcggccaagcaatggcgcatgtccaaagcttcttaccacttgccagcagcggaatggattggttagtccctgcgctagttggtgccgtctttggcacggcccactacttgttgttacagcgggcaaagaccagcactggcatggaagtaccgatgaaacgctaacacaaaaatttatgtctcttcaaaacaaaacgagtatcctgacaaagccgtctgggatactcgttttgttttgaagctattgatccaatcactctacatatagctcacttcaacttcataaatcacactgggaccaccgcagttctattaggtttcaaagattgtctttgcccatccacaatcaatgtcccaccagctcggctagcagtgactgatagttggtgttgatcttttacgacagtcacggtaccgcctttaatgggtaacacggtctgtaaatgatgaaattctgataactcaggcttgatctcaaaagtctggtatcctggagccgtgggccgtaatcctacaaaatgacgacccaataaatatatcggactggctccccaggcatggcacaagctcttaccatagggatcaccatacatggcatacatatccttgccatgctgtgacggatcgaattcttcccagaaggtcacggccccgcgatctaacataccgccccaatagtctaataaaacttggtaaacacggtgttgttcccccagcttacataaagcatcttgttcaaaaaatttaaaatacggcgtggtaatttgagtaatcgcattattcaacaaaacattctttaaaattaattgttgtttgttctcatcaacaacgtcaaacagaatggcaaaaatattagcatgacgagtaacgtgccgcttacccgattcataactatcaataaatgctccttgttcatcatcccaaaaatatttcattaagttcttaaacaactggtcatacttcgcttggtagcccgccacatctttgcctaagacctcaccacaagtcataattgtcttgtagtcttcaagcaataagatttgttcagccgccacggtaccctgtttatccatttctgaccaatcgacaaagatccagtcatttttccgaccataaataaacccatgctcatttgtctgttgaataaagtattgcaccatactctctaacttagggtaaataattttgagaaattcacggtcacccgtcatctggtaatgatttagaacaccaatcacccacaacatggaatagtcgacaattgtattcatatgttgcttaatatcatcttgcccacgcaacgctaataacgtccgtttatcaatatcttcgttgaagaaagaatattgattgataaaattagcttggtacgcgtcaccagcccaaatccaccgatcacgtttgatcccatcgataaagaacaagtcactgcaaaggtttaacgtttccgtcgctacattccaaatttgattgatcaacttattatcagaggtaaaactggagggattatttttaggaatatattcgtgcatagcagttaattcaatgtcacctaactgacaatgaggcacaaagacatatcgaaacgcacgtttacgaacctttgttgtagctgtaacgtccgactgcttgtaataacacatctcaacatcccgtgcttcagtttcggactccccgtaacatagcgcgttttgactgtgacagttccattcacagcgcgaccaaaatcatataaaacgccaccatcaactgcttgttgtgctttggccactactttttctgtccgatattcaatcacattaggatcctggttacagtcagtgtagagaatatcgtgaccagcgggtaatgtggtgacaaaattgctagctagccaaccactatcagatttgataatctcaccaacaatataaattgtcggcaatccctgaacgttaccaacaaacacttgaatatcagtcgcacccgcatcacaattaatcgcatgatttaagcgatacttagtgccattaacatcaacatagcccgttcctttggcgagtactgtaaattgtgtggattcttttaaatcatagtgccgtttaaaattaacattacggttgcaatcatcaatataccaataggcaggccaacccatcccacgttcttcacgtttaaaattttgtaacatcccttggtggatttcaaaatcaccaggataccataaccaaacagcctcttttgacatgagcattatcctccttgattttaaataaataagcccggcaatgcccggcttacatttttaattcttagtaatattaatcagtttattcagaaaccgttttcatcgttgggtcttttaaaccggtcttcttaataatagcgacaatgatcactgcacaggcaccgaatagcaccgtacatccaaccataatccataataagagttgcggcgaatatcccattaatgttggcgttactagcgagaaagcagcggtcagcacccgaactaagccataagaaaagcccgtcatcgttgcccgtgcatccactggatagaaagtctgactccaaattttataaagggcctcaccacataatactgtgctaccagagtagaaaatataaacaacggtgaaaatcttccagtcattactaaagatccctgcagtcacaaaggaaagcaatgctacggcaatacctaaatacatcactcggtagcgatacctagtgtctgaaacctttaaatagatcaggttaactaacagacacacaatattggcaattaatgccacgattgtcgaataggcttgcgtacggccatcaacagtcactaagaaatagttaacaaatgacccccacgtattggccggcaaattccaaaatagataaaaaacagttagtagaatcattggtactaacaaaccacctgttcgcaatagctgacctaatcgatacttcttaaccgattgaccgttagatgcacagtccacatgttcatggtcaactaagtctgtttcaatctgtttaaaacgctttgaaaagacccgcacgcaccaattaataattgccactaatccaatccaaccaaataaggctgccgggcttcccataccactgttagcagttataaaaccaataaactgtgacaacaaaatgcccatcgtccaaaaaatctgagttgaagaaattgcccgaccataaactttactagacatccgttccgaaataaccgccaatgacgttggtaaatcagcaccagaggccaaaccagcaatcacaacaccaataatcaatatcgtcgtattttgtgcaattgcaataataaacgaaccaatcgcgacaaaaaagatatcagcattaaacaccgcgacccggccaaatttatccgacagccagccgcccacaaatgaaccaattgcaaccgcggccgtcagcatagtacttagtagtccgaccatccagctattcagtgctaaatattttgtccagataggtagcgctactcccagactaacgagcaacgctgcatccatataggaagctagaccagcaacaattattaagagtacgtttgctttactcagctttactttttcgtcaaccatcgcagatactcctcctaaacgaggtacttattaatcaagtacaccggtgtacagctccaagcatgacaataactatttaaaatgggactcccatacggcgaataatcaggttgattaggatcaaatgcttcccaataagtatccgcacctagcgtaaccattttgccccaataatctttcattaattggacggcctcttgctttaagcctgcttcaaataatgcttccgtaatatggtgatacatatacggcgttgcaataccagtaattggaaacagtttcgtgacggtcgtttgcataagcaccatggtttgctcaggatccaaaacatgtgctagtgtcatccacacttggcttgccacattaacttcacgctgatcccctgagacaaataaccccgattgcgaatcaaacaattgagttttagcgtactggtttaatttacgcagtatcgctgtataggtctctaagcttgtatcattaaccagttccgcaagcgtaataaattgttttagcgtataaataataatggcctgcccagccgtttctttgtcaaaatcatttgaccagtcgatgaaaaccggattttcttcagtcaatttcaatttaccttcagaagtaacttgttccaacgccaaatccatttgctttttagcaacacgatataaatcattcaaaactgttttatcagaactaaacgcctcataatcagccaaaattgaaataaagaatagactgtaatcaaacaagaaggtgtcatctggaactgccgttggtttagtaaaaacattggcaggaatccggccagccgttgtaggcatcgcaccgaacaaatacagacaccgcttgaccagatctgtatctttgaacgttgcataattggccaatgcttgtagccgaagatcaccaatccataatcgccgatcgcgctttggtccatcttcaaagacatcctgcatacaatcagctaatgttttcaagccaacctcataaatccgttgtaattgtacatcggctaattccggttgatgcactgtcgcagtgtctaccgcacttgtcgccgtgaccactggattgctaaaaacagctcgccattttggtgacgtatcaacaactgtgatctcagcataacgaaaactatagcgtcgtggtaacgtcagcgtggttggcagcacatctaagtgaacagtttcttcttgaatccaagatttgctcaaccaaccgtcgtaatcttcactcttgcgtgctaattctgcaggcatttccgcaaacttaatcttaaaacatagtggtgcatccattggtgaaccaacagcgttaatattaatactaaattgaccaacctgatgatcgccaaaatctatgataatttggtcatcacgtttcaactcataacttgataatcgttcaataggtgcaatttgtttaacacaccatccttcaaggtattgcgtatcacgctcgagcgccacaatcgatgccgccttagctttggtttctttcagtattggccgatagcttgccgacttgtctaataatgcttgattatgctgaaattgaacatcattattgatttgaaaagtaaacgccatctcttccactcgctttctaaatactttgtttaaaagttattaataccatgcttcttttccaatcgcatcatcgtcagccctgctacaaagctaataaagacaatggcagcgaacccaaacatcgtgttacgaattgctgatggcacaactaacgcaggtgtaattaaggcaaataggccacaacatacccgtgaaaagccattgataaatccttgaactgatgcccgaacttcaactggaaatgcttcctgtgtccaaactttatacatcgcttcaccagcaatattattcccaatgttgtaacagccaatcgtgatgacaattggccataacgaatgactactcatcgctagtccgagcattgccaaaaattgaacggtaatcccaactaagaagaacttattacgatacttacccccagcgactgatgcaaaagccatggttgccaacaacgagataaagtttaggactatcccagcaccagttgcgaaactttgactcgcatgtgcttgaaccagcgtaaacgtttgaaactgtccgaacgtattggccagtagattccagcaaacatagaagattaaaatactgaagaagaatgccataaagcgtcccttgttggcaccagcgaaaaccgtcttaatcgagaccttttctgttgtctgtgaagctgcttcgcgatcaatacgccgttgttcaccttcttcatgaaatgctcggaacttagttgaaaaagtccgccatgcccaagtaatcaaggcaaaaattgctaaaatcgaaaaaacaatccgagcaccggaagcaccggccattttagaaacaataaaagcacaaacataagacataaaaactccaatttgccagaagatttgcgtcgacgatactaaactagccgaggtcttatcatccggtgcatcatgcgaaactacggttaaactaattggtaaatcagcacccgaagctaacccggtaatgatgacgccaatcaaaagcatgatataattattcgagaaaacacagatcaaggcgccaatcgcataaatcaggtttaaccaattaaacgatttaactagaccaaaagattttgttatctgtcctgctaataaggatccaattgcaattgcaaaagttagtgcacctgaaataataccaacttgactgttagtaagacctagtccgttctgccacactgtaatagtcgcggataagccaacgataattcctgatcctagaatggaaccaattcctgcagctactgctaatggccgatattttttcaccattgaagttgacgtctcgccgttattcatatgaagaacctccctttatttatacgaatattgtaagcgattactgtaaggggtaccatatctcgactacatgaatgatcgtgcaaaatcacaggttccactaaacgataaatattaaagaaggttagtattaatgactagtaaatttctcaattacgaattatttgctctgacaccggttgagctaaagcaacgccaatcacatggtaacgttaactacatggacttagattatgtgaataatccgattccccagatgccccgctcagatttttttaagcacggtgatattgctgttaccaaaaataatcgcttttcctatgttccagctcacacgcatagctttattgagcttaattatatgtatgctggcacttgtactcagtatattaatggcgaaaaagtgaccctccatcagcacaacctaattttgatggataaagacattgttcagcaaattgaatcaacgggcagtaatgatattttgattaacatcttgctcaagaatgactcaacgatgaaccaacttttcgactatattgccgtttcaaccaatgaaatcactcaatttttatataatgcatcccacatcaatacgttgcacaacaactttattctgtttgacttaacacaccaagaagttgccatcaatctagttgaaagtttaattatcaagggccttacaaagagccgccaacgtaataaatcaatgggcctgctgctatctacattaattcttgaattatcgcaatcgattgagcaagaatacattaacttttctgacaatacggacgacaatcttttgccaatcattcagtacatcaatcagaatttcgccagcgtgacattacgtgatgtcagcgccaagttctcttataatacaaattatctgggtaacaaattaaaagaagcgacgggcaagacctttaaagaacttgttgaccgccgccgaatttctgctgcccaaaatctgatgatcaagactaactgtacactcgctgacatttgcgacatcatcggatatcaaaacacctcatcactctttcgtctgtttaaaaaatgcctaaagaccaccccatccgaatataaacgaaaagttagtggcccactcaagcagtaaaattgaccgctgcgacaaacgtcatatatctcactaaagtaaaacaacaagtgcactcagattagaaatttccgagtacacttgttgttttactttaagaccattcttagtatcacgactaacaataattgatctatttggttagtacttccaggaacacctgtgccatcatctcagcatcatcttgaattgacgcttgcatgtaagcgtcctgctgtgcctgggtatagttgatgtcaaaaccatgctgccaagccaaaacctcagtaaacagccgcgtcgtgcggccattaccttcccgaaacggatgaaacatgttgattttggtgacaacttgtcccaacgcctgtgcaagctgttcccggtcattcggtaacatcgcaaaattatcgagttggcgttaaatatccatttcagcattaccaaataaagccaccgggtggaaaaacgtcaccacgccattcgcagtcttgttgaaatcaacttcgcgatagtgacccgcccagtcgtaaacttcgccgagcaaaaatgcattaatcagtttcaattctccaatttgacgtcccgtcaattatcgagagtccggtagaagataatggttgcgagctaattgctgttgtcgttgcgtactcactttgtactcgattttctgcaaagtagtcgcttcagtaatgcccaagcgatttttcaaagttccatttggttgtaggtaatccgcccatacttttttcattcagctttcctattggtcgaagtacatatctttgctagcatctcttgggcactaatcgggccttcgtcatagaaacgacgagcatcttggatatcttccttagtcggttcaaaaccttcatacatgttactgataattgcattcatggtcgcccggtattcctcttgattccgaaactgcacacccatgatggtgaacttctgatcatcgtgttctaaatacataatcgtattctcctcctcgaggtttgtcagtgcggtatacaccgcatcgtccgtagccaaaatctgaatcaaacgtaccgcggtgccacttggttggtagtccgcttgttcccagtgctgcaccgttctaaccgaggtgttgagtaactttgccagctttgcctgactaatttggtaatgttgccgaatctccttaaggattgtggcggttgttttcattttcatcacctcactcacaattatacccttgaagggtataattgtcgttgctgtggcctcacaccttagcaaaacagaccaactaatcagaaagcagcagtatgaccaatcaacccattcacgcgcgctattcaataccaaacagtaccccattaaagtcatgcaccactttttagcaatcgggtgacacattaattaattacgatatttctgctaaatttcacgaacactcgatgatttcatttggtgctttcacgttctaccaacgtcgttcccagttcaatgcgctgggctgcttgacgatcatcttggaaccggctcaccaacaaatcgatggccgtctttcccatcagttcagtctcaacattgaccgagctaatctctggatacacatattcggccagcgtcgtgttattgaagctaaacaacttgacccgctgtggcacagcaatatcagcttgctgtaacgctttgagtgcaccggctgccatcggatcattagcgataaagaaggcgtgtggtaagcgatcacctaacattgcaatggcccgtttcatcatcagataaccagattgactagtgtaatcaccagctaatacatactcagcatgataggcatgatgccgctgcaacgcctgttcaaagctttgctgacgttgattgggaatctccacctgctgatcagtggaccactctttgccataaatcatgccgatatcctggataccacgccgccaaaaataatcaacgacacggttagtagcaaacgtaaaatcagtcaccacactgctaaatccctgagcaaagtgatcgtcatcaacaaaaacaagctggtttgacaaacgactcaactgttgtacttggacaggactaaatttccccaccgccacgattgcatcaatatcatcgccaacctgacctaaattattctgaaagatactagtcgtcgtaaaaccacacacttgagcttgatgctcaattcctttacgaattgctaaataatataagtcatcatgttcttgagtcttagaataccactgaatcacagcgatatttttccgcattagcgcctttatatgctgacgtttacgcttactgtaccgcagctcgccagcaatcgtaaacacgcgcttgcgtgtctgctcgctcactgatagtgtcttgtcataatttaagacccgcgataccgtcgccaatgagacatctgctcgttgcgcaatatcttttaacgttacggccatcgtcattcctcttttctcttaattagcactgaataacaaacgtggggcaactgggcgtaacactattcaccaaccatgactcatcggtaaatcgcgtctgcaacaccccgttgccccacgtcttcatttgattaacaacttaatcgtgcattgctgcgacaaaacgatcaaaggctgcctcaccagcgtcatcccacttaaagaccccagcatcggccagaacccgggcaaagacgttgccgaccgccgtatcaatgacagtcgtcacattgtcagcggtgatggtattagtggccttcaattgatcagcccatgcttgatgcatcgcgaccatttgattaggctgatccaacaagtatttgccgacttcagctaattcggtcttcaaccgggctggtaaaatggcccggcccatcacttcaatcaagccaatattttccttcttgatatgttgaacatcctgatgtggatggaagataccatctggaaattcagcagacgtctgattatcacgtaaaacgatatctaatacgtagtcatcgccaactttgcgtgcaatcggtgtcgttgtatgatgacgtgtgccatccgtataagcacgaacatccacactctcgtccgaataattcttccacgtctcatgaatcttcacagcggcatccgttaatgcaaccaggtcctgactcgtcagccgaatcgtcgacatcggccatttaacaatcccagccttaacacccgcgatacctaagtcaatcgtgcgtgcaattggcgctttcatcattggaaattcgtgccgaccaccttggtaatgctcgtgtgacagcatggaaccaccaacaattggcaagtccgcattactgcccacaaagtaatgtggaaattgctgaacaatttcaagtaagttggtaaaagtttgccggttaatgaccattggccggtgctcttgatccaagaaaatcgagtgttcattaaagtaagcatatggagaatattggaaaccccaagtattgccgccaagtgttaaccgaataattcggtgattgccccgtgctgggtaaccgagtcggcctagatagccttcattttgcatacatagttggcaaagtggataaccatcttgcggttggttacgcgctgccgcaatcgctttaggatccttttcaggctttgataagttgatggtgatctctaagtcaccaaacggcgtttttgctggaaagaccacgtttttcgcaatggcccgcgtcttgatataatcattagctttgcttaagttaaagaaatagtcggttgccgtttgcggactaacctgatacttatcccaaaaacgttggtttaatacggatggtaacggggtcacaagatccatcaattgatccgctaagatatcttcatccgattgggtcgcttcgatcttgccattttgaatcgccgttttaaccaaggcatcggttaaacttgttaattggtcatcgcttgccgcaatcggatcaccctcgccgaccaaaccaagaacccggttatgcacatagattcgatctaattcagtatattgcgaaggcgacgcgatcaccgccgtgacaaattgatccaaactcgtcattatgcttggcctccccgatcatcatagccggccggatgactttctttccaagtccaagccgtcttgataatttctttcacatcatcatactgaggtgtccaacctaaaacggtacgtgccttgtcgctagcggcaaccaatgtgcttgggtcaccagcgcggcgtggtgccatgactgctggaattggcttaccagtgacttcacgagcagcgtccaacatttgtttgttggagaagcccgttgaagaacccaagttaaacgcatcgctatcgtgcccctgctttaggtattccaaggctaagatatgtgcatcagctaaatcgacaacgtgaacatagtcccgaacattggtcccgtctggagttggatagtcgtcaccgaagatttgtaattgatcccgttcaccagcagctacttgtaaaataattgggacgagatgcgtttctggtgcgtgatcttcgccgatgctgccgtcaggcttagcccccgccacgttaaagtaacgtaaggccacgaacttaatcccgtaagccacatctgaccagtgcatgatcttttccatcgctaatttactttcgccgtatgggttagttggcacttgtgggtccgattccttgattggcacctgcttaggttcaccataagttgctgcggtcgatgagaagacgattttcttcacatcgtgcttagccatcacttcgagtaacttgaccatccctgccgtgttgttatcaaagtacttgagcggatccttcatcgattcaggaacaactgagaaagctgcaaaatgaatgacaccttcaacgttttcttggtcaaacacggtattcatgaacgccgtatcccggacatcaccttcataaaaacgcgcgtgttcattgactgctgcccggtgccccgtgactaggttatcaacaaccgccacgtcatacccctttgcaaccaaccgatcaactgcgtgtgaaccgatgtagccggcaccacctaaaactaaaactgccattctaattcctcctcaatatttctcaatgcttactgctaatttgtattttaaatcaattgttttattaaagttccttagggccgtctgcgatttcagcaatgtagaaatcggcgtcgtaaccaatcgtgtcgcgataaactttaccgacgttttccttaaaggcatcaacttggtccttatcaacgatggcaataccacagccaccaaagccagcaccagtcatccgcgcaccaagcacgcctggttgtttccaagctgtttcggccaacgtatccaattctttcccagtcacttcatagtcaaagtgtagcgaaacgtgggaagccgtcactaattcgccaaaggtcgtcaaatcatcgtctgccaaggccttagttgcgcgaatggcccgttgattttcgaaaacggcatgccgggcgcgcttgattaaagtttcatcattgattaagtaggccgcttcgtcaaactggtcattagttaaatcgccaagtgatttgatgtctaacttagcttgtaatcggcgtaatgcttcttcacattcggagcggcgttcattatattttgaatccgccaattcgcgccgtttgttcgtattcatgataacgattacgttgttgcccaactttacgggtgcataagaatagtccatggtgttggtatcaagtaaaattgcttggtcctttttacccattccaacagcaaattgatccatgattccggagttaacaccaacatagttgttttcgcacttttgaccaatcttaacaagatccaattggctaataccgagattaaagccagtgttcaacatgattccagttaataattcaattgatgcagatgatgataatccagcaccatcaggcatgttgccatggacgtagaaatcaaagccatgatcgaatttaacgccggtctttgcgatttcgtccatcattcccttaggataatttgtccaaccagcggctttgtcatatgacaggtcgttgacatcaaacgtaacgaccccagcatctggaatgttagctgagtacatccgcactgtcgtatctgtccggggtgcataaacaccatatgtcccgattgtaatcgcacatgggaaaacatggcccccgttataatcagtatgttcaccgatcaagttgattcgaccaggtgagaaaaagacccgttctggcttggtatcaaaggcttcggtaaactcctgttttaagtcgctagtattcatgaaaaatccctccgtaaatagttttactaaaattttattagtttgactataatgcttttttcgatcgttgtcaacaccccgaaaaacctttaaaacaagatttgataacgctttataaatttatcacgttatcgattcaaattcttctcatagcccgttgtcgttttcagcagtcattgtcatttagttaaaatttaactaaaacgacatatacaaacttaatattttgttttatgataattgtaagcgtttttatttatataactttgaaaggagcttcctcatgcaagctaatcttcaatggttagatgacccagaagtcttccgggtcaaccaattacctgcacatagtgatcaccattattatcacgacacagcagaattcaaaacgggtagtcgcttcatcaagagtctcaatggcgcttggcgttttaacttcgccaagacaccggctgaacgcccagttgatttttatcaacccgatttcgatgcaaccgactttgatacgattcaggttcccggtcatattgaactagccggctatggtcaaattcaatacattaacacgctatacccatgggaaggtaaaatttaccgtcgcccaccgtataccctcaatcaagatcaattaacaccaggcctattcagtgacgctgcggacaacaccgtcggctcgtacctcaaaaccttcgatctcgacgatgcttttaaagggcaacgtattatcattcagttccaaggggtagaagaagccctgtacgtctggttaaatggccattttattggctacgctgaagatagtttcaccccttcagaatttgatttgacgccgtatattcaggaccaaggtaacgttttagcggttcgggtctacaaacgcagtactgctgcctttattgaagaccaagatatgttccgtttctctggtattttccgtgacgtcaatatactggcggagcctgctagccatattactgatttggacatccgaccagttccaaatgccaatctcaaaagtggtgagctcaacatcactactaaagtaaccggcgaaccagccactttggcgctgaccgttaaagaccatgacgggcgagtactgacgagtcaaacgcaaaccggtagtggcagtgtaacctttgataccatgttattcgaccaactgcacttgtggtcaccacaaacgccgtatctctatcaattgacaattgaagtttacgatgctgatcaccaactcttggaagtcgtcccatatcagtttgggttccggacggtcgagctgcgcgatgacaaagtcatttacgtcaacaataaacggttggtgatcaacggggttaaccggcacgaatggaacgcccacaccggtcgcgttatcagtatggatgatatgcgcgctgatatccaaaccatgttagctaacaatatcaatgccgatcggacctgccattatcctgatcaattaccttggtatcaattatgtgacgaggccggtatctacctaatggccgaaaacaacctcgaatcgcacgggtcatggcaaaagatgggtgctatcgagccttcttacaatgttcctggcgataatccacactggttagcagcggtgatcgaccgggcccgttcaaactacgaatggtttaaaaaccacccatcgatcattttttggtcacttggcaatgaatcgtatgctggcgaagatatcgcggcgatgcaggctttttataaagaacacgatgattcacgactcgtccactacgaaggcgttgtctacacaccagaattaaaagatcgcatttctgatgttgaaagtcggatgtacgaaaagccccaaaatattgtagcttacttggaagataacccaaccaaacctttcctagattgtgaatatatgcatgacatggggaattctctgggcggtatgcaatcatataatgatttgatcgacaagtatccaatgtatcaaggtggctttatttgggactttattgatcaagccctcttcgttcatgacccaatcaccgaccaagacgtgctccggtatggcggtgatttcgacgaacgccactccgattatgaattctccggtgacggcttaatgtttgccgaccggacaccaaaaccagcaatgcaagaggtgaaatattattatggcttacacaaataatcaactacacgttatttacggcgacgggagtttaggactacagggggctaatttccactacctctttagctacgaacgtggcggacttgaatcactcgtcgccaacgataaagagtggctctatcgtacacccacgcccatcttttggcgggcgacaaccgataatgatcacggtagcggcttttcagtcaaatccgcacagtggtacgcggccgataagttctcaacttgtcaagatatcgaattgacggttgacgaccaaccagtcacaccgttaccaatcgcgccactcaataacaaatacacagatcacgaaatcgccacgaaagtttcactggcttaccacttcgttaccacgaccgttcctagtaccatcgtcacagtgacttatacggtgacagcagacggtcagatcaatatcgccacccattatagcggtcagtctgatttgccagagctacccgcatttggtctgcggtttatcatgccaactaccgcgaccggcttcgactataccggtttgtccggtgagacttatcctgaccggctggctggcgcaacacacgggcaattccacgttgacagtctgccagtcacaccatacttggtcccacaagaatgcggcatgcacatgaaaactgaacaagtgacagtaacgcgatcaacaacacaaaataacgctgaccacgacaacacaccattcagtttgacatttagccaagccgatgcaccattcgccttcagctgccttccctataccgctgctgaactagaaaacgcaacacacatggaagaattaccattagcacggcgaacggtcttatcaatctacggtgccgttcgtggggtcggtggcattgatagttggggaacggacgtagaagccccatatcatatccccgctgatcaagacattgacttcagctttaacattcatttctaaaaattaatttgatttcaaaagaacgctccggcaggttatttgccagagcgttcttttagattaacgatgattaagttttaatatgtttaatggctgagcttagtccttagccttgaagtaatgtacctgcgccgtaaagtcactagtttgaacgggagtcgtgtagagtcctagttgcatcaattcatcgccaccgtacattttgtttgtgtcggtctcaacgtaggtctgctgagggtctaatcccactagcttcgtaatatgcggttctggttgaactgcacctaaaataacgaaggtgaacagcaaggcttctttctgatccggactaacaaacatccacgcgaccgtattagattcaaacgggctctctaatcgataaaaggtcccgtattgaactaactcacggtgctgcttatagaaggcaacctgtcttttaacggcctgcttgtccgcatcacttagttgggccgcgtccagttcatagcccaaggtaccactcattgccacagcaccacgcatcttcatcgacgtcgaccgtcctaacaattcatccgggctcgtcccaacatgggcggtaattgcagaaattggataaacgagtgaagtcccatattgaattttgagccgttcaatcgggtcattattatcagatggccaactctgtggcatataatacattaaaccagcatcgaagcggccaccaccgccagagcagccttcaaataaaatctgtggatagcgtttcgttaaacgctccatcaagtcatatacacctaagataaagcggtggctagtctcaccttcatgagctgaatcgctatgtggcgaatagacttccgttaaattgcggttcatatcccacttgatataatcaatgggcaccttatcaagaactgcggtcatttgttcaaaaatattgtcgacaacatccggttggctgaaatcaagcacgtattcgttccgcgataacgttcgaccacgatccggtacgcctagcacccagtcaggatgggcccgatagagttcggaatcagccgaaatattttctggctcgaaccaaagtccgaaccgcatccctttatcatgggtccgtttgctaatatccgctaagcctcctggtaacttgttccgattaacaaaccagtcacctagcgaactattatcatcatttcgatgaccgaaccaaccgtcatccagcacaaacatttcgatacccagtggtgctgcagcatccaagattgattgaatcttgtccgcatcaaagtcaaagtaagtagcttcccaattgttgatcaagatcggccggagatcgtgcttgtaacgactgcgcgccacgcgatcacgcaataaatcatggtaggtttgcgacataccattaagccccgtcgtcgagtataccattgcaacctcaggcgtttggaaactagcaccggccgccaatcgccagtcgaaattatattcattgattcccatagtcaagcgcgtctgaccaattgggtcccgttctaaactaatctggtggttacctgaataaattagcaatgcaccaaggacattgccttgaaattcattagtattcggatcagctagcgccacaaaaggattcatatgatgagaactagcaccccggcgactttcaaactgagttacacctcgatggagccgttcacgactaagctggcgctcacgcgcatagcttccaggtaacgaaatggcatctaatggttgggttggcaggtccatctgcatcgaagccactttttctaagtcgacagcttgctcactgtgattaatcaaccgagcgctacgcgtgataactggccgatcccgataaatcgtgtaggctaattcgagtgtcacgcctaatgtggcatctcgcaacgtcacaatcaaagtttgggcttcatcctcatcttcgacataagtttgtggcaagcccttaagttccggcttatcggcttccatccggcagtcttgataacgaaaatcaactgttcgagcaccattggccgcgcgaataatcgcggcgggttgccgataatcaccggtattattgccaccgtattcctgtggcaaatcatccttggaatagcttcgatcagtcgtattcggtaaatttcctgagaacccccgatcaatccggggatactgacgctcgccatgataacctcgaacccgtgggccaaagtacaagtgggccaacacgttgcctgtctccacacctagaatatacgatatttgatcgttatgcaggtgaaagacaagttgttcttcatcaatgtcaattaaagtttgctgcaacgttactgccatagtaaaatcttcccttcgctattagctttttctatttcagttcacaaaaagagctattaatggctcgcgtcattaatagctctcctcgtaaagaaactatgcttgatccggtaagccgacattcgataattgtaagacatcttcatcatcttgtacggtggttcctgaatctttaagatacgtaaattcgggcatatctttatagtttgtaataacgaccataacggtatcatccaagccagccttttcaattgctggttgccagaattcaattaattcttgcccttgtgtgacatggtcgcccttctcaacgtactgaacaaatccagtcccgcgcatcttaacagtaccaatcccaatatgaattagcgttaaaataccggtatcagaacgtaatccgatcgcatggcgagtcgggaaggttgcaacaacttcaccatcaaatggtgcgacaacgcgaccatccgttggtttaatggcaaaacctttacccatactaccgtttgcgaaggattcgtcagcaacatctttcaaactgatcagttccccggcaacaggatcttgataaaccgtcgtcttggcatcggcttctgcttcaacttcagcaggagtttcatcggtttccaagtgtgttgaccatgttttttcaagttcatcaacgatttgtgcatgcatcttttcatccaacttaaccttcttgaagaagatgaatgtcccaatcaaaatcatagcagcaggtacaccgaacatcattaacttgaagatggcagcgccatggctagtcacatcaccagcagtggcaccagctgtcatcccagcccaaacagcagttaaaccaacgacaccgttagaaatcgcaccgcctaatttatcaagtaaaggccgaacggataaggttaaagattcgtcacgatgaccaaacttcaactgcccatattcaacagaatcactcaaaaccatcaaaacaactaagaaaattaatggttgtggaatgtagaataatacggccgctgttaagatcattggtaatgactgaccagcaaaggcaaacatgatcagtgaaatcatcataataacaactgctaagaagaacactttacgacgactaaacttctttgctaatggtgggaaggccaatacggcaaaaatcccaataaccgcatttagcgaacctaatagtgtaaacttcgaggcgtcacccaaaatataagtgaagtagtaaagttctagtgagttcgtaatggcaatccctgccgtgtagatcccatacatcaatgataaccacatcaattgatcgttacgggctaacactttgaagacttccttgaagctagtcttttcagtgttcttacgcaattcagaatcattttctttggttccaagtgcaacaactaaggcagaaatcaaagcgattgcggcaataatgatcccaaacgccatccaaccacggttgtcaccttgaccactgttagacttaacagaaaacattaagacgattggcataacgataaccccaacgatgttggcaccaatgttagagccaacccgggcgtacgtcgccgtcttttcacgttctgctgagtcaaatgagattgctggaatcattgaccaaaaaccaacgtctttaaacgaatagaaaatatccattgtaatgtataaaattgcaaaaataattaaatatagaatggggtttgaggtatttaatccgcctaaactcgtgaataaaagtgctaaaacgacggaacctataatcccaccaatgacaatccatggtttaaagtggccccaccgagaattagtattatcaatggcattcccgatcaaaggatcaattgctagttccacgaaccgcaaacctgcaataatcatggtgatccaagcaatcatttgtgttccttgagccccactactcttatcgaacaagtgggaggtcacaaacataataaaataagttgataaagtggcatagaaggcatcgtgcccaaacgccccaaatgaataagcaagtcgcgatgttattttacgacctttactctgctttgtctctgcatccataatctcgcctcacatcttccttgaataatttacaagtttaaatgtaatcgttttcagaagtaatgtcaatgatttttagtaaaatttgttcaaaagttttatctataccgcttttgattaggacctgctaatgcgcctatcgacactgattgcccgctttccaagggcttaagcagtatagtactcattatcttaccaatgatcatcgttttactaatcacggtattaatcagatgctcgggactttgttaactaaattaaacattgtttactcatacgtttacaaaaaaggcgccaggcagaactcgcctgacacctcaactagtattaatttaaccgttcatattggtaccgaatcgtatgcgtcactggtgctcctggacgtaacacaatatcaccaaaaccaggatgattgattgcatcaggaagtgtctgggcttccgtcgctaacgcattatattgatgcgcatcttccttatcagtatcaaacggattagccgtgaagataataagactatttcgatctgaataaatttttacttggcgcttatcatcagtatccccaacgatagcaattggttctgccgcacttggggcgacttcatacgcatcgtcaaattcaatgccaccattctcagtcttcagctgggctaatgccttttcaactggttgtgcctggttaaagtcatacgctgtgcctttaactgctaatttcttaccagttgggactttttcatcatcaaattccaagtgagctgcactcgtaatctgtaatttttgttgggccaaactggtccgatcatcagttgtgttccaataaacgtgattagttggattaaagagggttgctgcatcagtatcaccggtaaatgcaatggatacttgatcctgattatctaatgtaaacttgatagcgacatccatatttcccgggtaattatcatcactggcgttgatatgcttcttcaaagtcacactgacactatcattggtttggctaaaagcaccttcaaagttcagcgtgttaaaaccatgattcccgccgtgtagcgaatgggtttgttcgttcatatcaacttgataggattgatcatcgattttgaacttagcgccgccaatccggccagcaacccgaccaattgattgacataggcagtatcccactcgttgatagtcagtcatgttatcaaggccccaaatcaagggatgttcaacgccgtcttcattgacgacgaattcttgccacgtcccaccataactaaggaccgagatacgagtttgatggtcattgaccagcgtataacgcattacatcttgaccatctagttggtcaaacaccgtttttttagtttccaaaatcatgcacctccgtgttatttaaaccgctttcatttagaagtataccagaatttcttgaagttgagtaaaacttttagttaaaatactaaaagaacgatctggtttctatcccagatcgcccttcactacttggaacttgctcgctcaaccagattagtacccagctcaacccgttgtgtcgttgttcgccctgctagtcgactgatgaccaaattaactgcggtcgcccccattaactcagtatctacgttaactgcgcttaattcgggataaacgaatgtcgccagcgaagtattgttaaagctaaatagcttcactcgttctggcacctggatgccattagcttgcaacgctttaagcgcacctgccgccatcggatcatttgccacaaaaaaggctcctggtagttgatctcccaacttacgaatggctttttgcatcattttaaacccagattcactagtataatcgcccttaaaaacgaacttaggatcaaacgcatgccgtcgttccatcgcggcccgaaaacctagcatgcgtcgatcaactaccgctaactgatggtcggttgtcatttcttgaccgtgaataaagccaatatgatgaaagttgcgttgccaaaaataatcgacaactttttctgtggccaaccgaaaatcagtaatgacactatcaaaaccagcatcaaactgatcatcatctacgaatactaagttgtcagttactgatgccaagtccttgacttgtggctcgctgaactttccaactgcaatcactgcatctacgtctggtcccaattcttgtaaattattttggaagatccgagtcacttcaaactgattatcctgtccacgacgttcaatccccatccggactgacatataatacaaatcatcttgttccttagattccgaataccattgaacaatagcaagtcgcttacgcgtcgtcgtgacagtatgccgtttattttttgaatactgtaatgcttctgctgcatctagaattcgttggcgcgttgtatcactaacagacaatgactgatctttgtttaacacgcgcgataccgttgccaatgatacgccaactttatttgcaatatcttttagcgtcgccgccatgaattggcccccttaaattcaaactaattcttactaccatctaaagtcgctatcgcatgatttatttgcaaattattttaattttcaagtattgcgccgaacttcaacgcataatcgtgataactatcatgtaaaactttatcattaattgtgaaaattggcgaatttaaacactaatttatttagtaaaggccccctgtgcgtgcaaatctgcaaaattatgttattattaacttaactattaggtacagaaagggccatatcctcggatatggccctttcttttgcggctctataacattgactatagcgaattgtgcaaacgctatgatcgaccagcattccaatcaattgccggttgttcggtaagaatctgttcaatcgttgctaattctgattcactaaatttcaacttttccaatgcagcaacgttattaaccacctgctctggccggctagcaccaatcaagacacttgctaaggctggctgacgtaggttccaagccaaagccatttgagctaagctttgctcccgttgttgcgcgacttcatttaagcgctttaccgtagctagtgtctgttctacctggactggactcaaaaatggaattgtttgcttattggcccgtgaatctgtcgtgattccatgcagatacttgtccgtcaataacccctgtgatagtgagctaaagccaaccgccgccttatgagttgcttgtagaacggggaacaagtcctgttccacctgtcgattaaacatattatagcgtggttggtgaataatgtatggggttcctagtgattcaaatatcttggtcatagcagccgtctgcttgccattataatttgaaatgcctacatacaatgtcttaccctgccgtactaactgatcaagcgcagcggccgtctcctccattggtgtttcaggatcaggacggtgactataaaaaatatcaaagtagtctaaaccagttcgctgcagactctgatcagcactggcaataatactttttcgtgacccccaattgccgtatggtcccggccacatcacatagcccgctttactagcaatgaccatttcgtcacggtatggccgcatatcggtagccataatacgaccaaaattagtttctgcactgccgggttccgggccatagttattggctaagtcgtagtaggtaattcccaaatcaaaagcttgatgaatgattgccttttgattagcgatcggatcaacgcttccaaaattattccacagacctagcccgattgctgacagcttcaagccactattgcctactcgattataaatcatatggtcatagcgcttctggcttgcttgatacatattaaacaccctctcgttattagttcctagctaaagttaccgctttcatcagtaaaaagcaacgcctggttttaccatgctacctccgctaagattattgagacatcgaacactctcacttgataatttatatatatcaactacaatatattatgagaatataaacgtaaaggagtacttattatggaccctaaatttattgaagttatcaaagacacgtcccccgcaaccatcgtcacggtcaacgccgcaccagcacacgtcgtcaacacctggagtcattatatgcagcttatcgatgatcataccctattgatcccatcggctggcatgcattcaattgaggccgattttgctaccgacaaccacattacaattgctgtcggtagttacaaggttcccggcacaactggtactggctgtggtttccacattcatggtaccggcaagtttgaaactagtggcgcttatttcgatcaaatgcatactaagtttgattggattcgcgcgaccctggttgtcacaatcgacgatgtggaacaaaagatttaaccattaaaaataagagttgtattccctcatactcaaggaatacaactcttatttttcaccttagtaatctcctattcaattgtcagtccgctagcctcatcaaagaaatgtgctttgctcatctcaaatgccatccgaacactttcaccaggcttatggaaatcgcgtgcattaacttgggctacaaattctgtatcaaccgttttggaatacaagttagagtccgtccctaaaaattctgaaacgaccacttgagcattaacaattgcatttgggaatgtttgtagcgcaacttgttcagtatgaatgtcttctgggcgcattcccagcatgacgtctttatcttgatacccttgctcacgcaaaatcttcagtcgaccttctggtacctcaacatcgagtcccttgccatttaaaactcgattgtcatataaatgaaccttaaaaaagttcattgatggtgaaccaataaaaccagcaacaaactgattagtcggcttattatatacctcatctggcgtgccaatttgctgcactttaccatcattcataataacaatccgatcagccatcgtcatcgcctcaacttgatcatgcgtaacataaatcatattcgtctgtaagcgttgatgaagttgcgcaatttgtgtccgcatatcgacccgtagttttgcgtctaagtttgataaaggttcatccagtaaaaacaagctcgcatcacgtacaattgcgcgtcctaaggcaactcgttggcgttgtccaccagataaggcacctggtttccgtaataaataatcactaaggccaagaatttcagccgcatctgcaactcttttcttaatctcatcatgttgtactttacgaatctttagtccaaatcccatattatccgcaacagtcatgttaggatataacgcataattttgaaacaccatagcaatgtcacgatccttgggctgaaccttatttacaacttgcccattcatatacaatttcccctgactaattgtctctagccccgccaccattcgtaacgtcgtcgatttaccacatcctgaagggcctacaaatacaacaaattctttatcttgtattttcatattaaaatccgtaacagaataatcactgttgccagtatacttcttatagatatgatctaaattaattttcaccattctgaatcacctttttcaaggatcaagacttattacaattttttggtagactctctacggaccaacttgtaaggaacatgtcgctcaatggttgcatccggatgctgcccactcaaaaactgttgtgccaagcgcgcagcttcttgaccaaattcataaggctgctgcacaattgttgagagcgttggcgaaatataagcatctagatccaatccatcaaacccaataactgcaacatcttccggcactcgttttcccatatccttaagtgcttgcataactcccagtgccataatgtcgcttgcacaaaagaagccatcaatattaggatcgtttgacaagacccgcttagccatcaagttagcaatttgttcatcataattagcatattgaattcgacctgaattaatcgacagtccagcatccgttagcgctttcttatacccccgttcacgtaaaatactaacagtcgcatcatatgttccgttcataaaaccaatgttcttgcagccacctttaattaataaattaactgcatcagttgccgctgacacattatccgtagttacggaacaaacattgggattactatgaatggccatatcaattaacactgtaggtacacgggttgtctttaactgctcaacgtaaggatcactttcatgtagtccttgtaaaatgacacacgtcaaatcgtgctcactacaaaactgttcataagtcttttccttttgtttttgtgttgtaattgcataaaatgcaaactctacattttgcgaatccgcataatctaatacaccgttcaaaattgacatcggaaaggtatacttaggcatataaaccaatccactaaatactagtgctatcttcttctgtcgtttcgaagagagtgttcgtgcagccaaattcggtgaatatcccagctgatttgctaccaagaaaacatgcttacgtgtttcctcactaatatccgaatagtcattaaatactcgtgacaccgttccaatcgaaacgccggcctttttagctacatccttaatcgttacctttttcaaaacgacaccctcttatattattgttaaccggctacttttcaccgtccattcgtacaccctgtaagaagtatccgttaaagataatatacaatataatgattggtacaatagaaatgatacttgcagccatcgtgtgatcccagcgaacccctgaggcttgactcgtaaaggtttgcagccccaatgtcaacgtatatttcttaggtgtagaaatatatagcattggttgcataaagttattccagaaccccatgaagacaaagatcgcttgcgttgcgattgatggccgtgctaacggcataacaattctaaaaaacgtagcgattcgacccaaaccatcaatctctgctgcttcctccacatctattggaaatgataagaagaactgccgcatcataaaaatattaccaatattgattgcagccggtaagatcagtgaactaaacgtatctagcatacctaagttcattaaaataagatagtttggaatcaataaaacttgtgccggaaccatcatcaaagctaaaaatgcatagtaaatcttttggcgtccaggaaaatttaaacgagctaatgcatatccagccatagtatttaaaaataggtttacgattgttcctataattgaaacaatcaccgaattcatgaaccattttgtgaatagcgaagaagtcccagtaatatattgatagttagctaatgtaaaatgcttaggtaacaaccctggattaccactcacaatttcttttagtggcttaaatgaagctgccaaagcccataggaatggatataacgttaaaatcgcataggcaattaaaacgacatataaaataatctttaaaattttggatttttctttcaatgttcaatgcctcccttaacgcaacccattactaccatttagcttttcagttaagcgcgaaacaacgaaaataataactgttaatactatcgccaatgtacacgcgtaacccattgtattcatagaaccaaatgcatattgataaaccatcaaggcaatcgtcagtgttgaattatcaggtcctccagacccgttagaaaagatataggcttggtcaaacatttggaaagtaccaataattccagtcaacagaacataagttgtaattggccgtaaataaggaatcgtgatgtaacgcaatttctgccaggccgacgcaccatcaatctctgctgcttcataaaatgaatctggtaagtctactaacgaagctaaatacactgtcatataattgggcactgtcgaccaaatattcataaccatgataacttttaaagtatatgctggattctgtaagaagttaattggatgctgatatagtcccattgaaatcaagaaattatttagtggtcccgagatattaaaaataaacataaagattaatgttagagcagcactcgaggtcaatgttggcaaaaaataaactaatcgaaaaagcttcttgccctttataccacgtgtactcaacgcgtaagcaatcaataaagcaaggattgtttgaattggtacgacaattaccgaaaacagtgccgtatttttcagagcggtcattgcaacattatccttaaatacatcaatataattcttaaacccggtaaactcaaactgctgtgaaatcatattaacgtgattaaacgacatatacagcgcaaaaacaatcgcagcgacaaagaaaactgcagcaattacaaacgcgggcgtaagaaaaagataggcttcccagacttgaccatgttcaccgtttaatccacgtgctagtttgagtggttttttttcgtttccatcaatttcacctctctttgacacaataggactgcttacacagtcctattgcgtcaaaatttaatttgctttagaaattgcggcattagcttgtttatcagcgcttgtcattgcagatttcattgtcgtcttaccatccaaagccttggcaacgaagttttgatatgacgtgttaaccgtagtcacagttgttccatcttgccatacggtagaatacttagttgccgctaaccacgtcttcattgcatcgttatctgataacttaagtgctttagcgacatctggacgactaggcatcgttccaacagccttagcccacttggactgaccttctttgctagttgcatatgcaatccaggcactggctaatggtttaaccttgctacttgcatattcaccccaaccaaccgtgaaaatcataccgcgacgagcacctttataagacggcattggcaatactgagtaatcagtcttgtattgctgattttgaacttcataagtccaatttccttcttctgtcatcgcaacttttccagtcccaaaagcagtgccattgtcaccagatcctaaatccttggcagttgcaactgcccctgtggcaactaaacgttgatataacttcatattttcaagtactttagcacttgaaagattagagtcaccattggtcttgattggcttaccgccatcggttttcataatcgtataattgcgagccatatcttgatcataagtcatagcctttactttattcttaccataagctttatcaagcttggcctggaatcctggcagccatttaatcaaaccatcataactagacggaatacttgaaatccgaacgcctgtcttttcaagcatctttttattgactaacatacccaatgttgagttatctttgggaacaccatataaatttcccttcgtcttaaaagcattaatcaaatttggataaaatttcgccgattgcatttgtttagcatctagtttttcaagtaccccctgcttctcaaaccaaggatacatggatgaatccatataaaacgcatcaggtgctttgtgcccagacaaatcagcttgaatctgtgtattaaaatttgtatataccttagtcgtcactttagctccggtctttttttcgaaccctttaataaccttgttaataccagcacgttcctgatcgctaccataccaaattccgacttttaaagtttggcctttaaaatcagtttgttttgaagacgaggattgattgccacaagctgctaacaacccaactgacaccattaacgctgctgataccccgatacctttaatccaacttttcataacatactcactccttagtaattcacaagcctatgattacgctttcattttcacttagtcgatactgctggccccgatgttcaaagctaaccgactcagttgcattcaatgtttttactgacaaatgtcgcttattaatcgttacctgtaatcgctgctgttgccagaaaatctcaaaactcagttttgtccaaactttcggtaaatgcggttcaattcttaacgttttaccaagtaaccgaatacctccaaagccaaaaacaacaacgttccaaatcccgcctaatgatgctgagtgtgtaccatcattagacgatgccatgtctggtccaatatcaatctgacaagctcgttgaaatagttcatatgctttatcaggcatttttaaatcagaagctaacactgcatgtgttgacaatgataaggacgaatcatgagtcgtcttcggttcataataattccaattagtgcgtttatctttcgctgcaaacttttgttcaaacaagtatagcaggagcaagacgtctgcctgcttagttacttgaatgttagatatctgatctaaattataatcattgaagattccaccaacatgcgtagcactcttgtacttacttaaatcaattgtttttagggataaatacgtatcattttctggaatcacaccatccgcattgggctgtagtaggtaaattttattgacccgttcttgccacagttgataacacaaatccaagtctagtttttgattgagttctgaaaattttcggggttcattagtctttaatgctttgtacaaatcgattgccgtttgcaatgtccacttagcggtataatttgtaaatgcattattattaatatgctctttatattcatctggaccaatcacatcgttgatctcatagcgatcagctttttcgttatactccagcctgcttgcccaaaactttgcagcatctaaaacaatctcataaaccttgtctaatgcgaattggtcatcacccgtagcgttaatatattccatagcgccatatgcaacatcactggtaatatgctgttcaataaatcctgaccagattttcatggcccgtccagtaataacatccgcagcaccccaaactggtgttgattccccatctgaaggccatgacgcttcccatgggaattgtgcaccctcataattattatcttgtgcttttcgatgggcaccagttaatcccaagtatcgatattcaatcagactcttagcaacttttggtttagtaaagatataatatggcaatataaaaatttcagtatcccagaaagtgtggcctttatacccttcaccaggcaatcccttagcaccaatattcattcgatgatcatgtgctggtgtagatacagccaactgataacgggcaaaattaagggctacttgatcatccgcatcgctagattcaatttgaagtttgccatagttccagactaattgttgccaggccgtcgttgtcgcagcgagttgttcatcaaatatcttagtactctcaatctttagcatggcaagcccaaattgtcgtaatgcactcagatttccaccttgaaaatcattgtctcgatcagtaactaatgtgctgtactttgtaaactgtaaagttgctcgcgaagcaatgatatctgtaaacttgaaaaacacttgtcgccgaccgattttcatttgttgtttaatgacatgattatcagccgtattaaacttgtgacaagtcgtaatagccatattaattttcgattcattcgtactagttagcatctgcataaacgtcccatcaaaaagacgtttatcaccttcaattaggtgttgtgaaccattatttgtctgttggccgttaatacctgacttcaccttaacaacggcttgaccatcaagcggcgtgatattaactcgtgaaataactagatgtcgattggctagtgagactaatctttcaaactttaaccggtaaaaatgctcagctactgtccatgtaaaagaacgggtcaacaaaccgttcttgagatttatctcacgtaaataatcactgacatgaccctgatttaagtctagtacctgtccattgatctcaatttcaatttctgtaacatcaggtaggttaggtaactcattaacctcgccattaaacctgtcaaatgtcccagcaataagtgtatcacgggtttctccaacataatgttcttcagtagtcgcacggacacccatatagccgtttccctgacacattacggcttctaatttttctaagtgttgggaattaaattccttttcttgtaaaatccaaggattactcgggttggttctgattccaagttgcatacccgttgcccctctcaatatcggtaaaaatatctattcgatcggtgtaatataattcccgcacctgccaaatagatacctatttgaattacaatctgcaaatgtaaaataacggaaagaatgacaaatggaagcaagtaaccaagataccacttatagatctgacggatatcattatggtcacgatgcttataaacaattatcactgcataaaaaacagtcgttaagaacatcacaattaggccaactgtattgatatttgttaagggtaaatttctcatgtttgcctcatttctcaatgtgcactaagtttttctccaataccaccgtactattaccaaagtaatcgtgaatcatgcgatcagtcagtacacctaaaatcaaactaattagtccaaaaaaccaacccacaaatggtaagaaatagatcacttttgttacttctcgaattccagcaatcaacatctttccatttggttgctcatcgttaatcagaacatactcacgcccaatctttttccctaatgtttgaccgtggtaatttacaatcataatgacgttgtaaacaacaaaacccaattgacctaaaatatcagctgttctgaaatccgcatgtagaaacagaattgctaagacgactactggaacatatatcacaatgatgtcgaccatacctgacagtacacgtaacaggagatatttaccacgcattctgaccacctccctctatcgtttagactacaaaaacgttttcggatatggctaaaatatagcgctcactagtccttttagcaagcgctttcactgattttatgctgttcattccgttacattattaattaagtttataagttaaaggaaaaatccactgatgtatcagtacttcatagcagctttgatattaactaatattaattgagttgtgtcataaaaattaatactttcgtcaactagaactttcgggtttccaattgacgtttcacagctgcattaatagagtcaacacctactacagcaacttctacaccaatacattgagccggatttaactccatctgtaactgcattgttaactcaaaataattcttagctacaattaccactcgaaatttttcagttaggattctcatcgaaaaatcgaattctattgtgacacgcttagtatttctagagtctacattatcaattctaaaattcaacaattatggactagtcaacgaaataatcgtctgatgatgtttgacataatgtaagcgtcctctccataaacaattggcgtcattgcacataaaccgttaatcaacatttttggtaaatttcaagtttttgatcctataaatggaattgtatcgcgtacactgagatgtccatcactcaaggaaaagagtgtttctagtatatcaccgcttaatgaaatcgttttcatgaaattgtttttttgctactttcttccataaatatttcctagcaacgatcatcgttcttttgagcaaaaaaataatctgaaattaaatttcagattatttttcaacatctcattcatgccttgattgtcatcttttcatcctgtaacttaggcagtccttccaaaaagtgcccaaagcactgcttcaagaagtgttcactaccgtcatcattcagatgatcgttctcatcaaacttattgccagcttgaggtaacatgaactcgttaccaggcataactttggcatccacaccgggtgagtccaaaatctgtcgtaagttcatctgagcacgtaccgtaccttgaatacctaacgaagtcccaacaatcatcactggtttgtctttgaatggatgttccgcacaggacagccattcaatggcactcttcaaggcagctggaatcgaatgatcgtattctggcacgccaaagacgacaccatcagcggcttcaatcttagcggctaactcttttacacttgccggttcccgatccatatcatcttcattgaatagcggtaaatctttaatttcacaaatttcaaaattaacttgcgtttcaaataattctttcatggcatacaacaacttacggttatatgattttgaagcgttagtccccacaatggccacaatattggcttcgtcatcgcccgcggttgcctgccgctgagcgttttcgctagccgcggtgccggcaacgtaacccgacgaaatcccccaagtattcatcatacttggcattgaatcatgtccgttagcgccgccgatgatttcccccgcaccaaagtaattagctaccggtgcatttttagtcgttaccaattgcaagttatcagcatcaacactatagccacctaaagtcgtcgcaaagcgatcacgttgttcaatgatgtagaatgtttcaccttcaaattggtgcaagtacttcggatcacgaccgaaatcatgatcgtgaccatcttgaacatagccttgataatttttgaccgtttggactaattcatcaaccacaattccggcctgctcagcagcactttccaaagaacccttaacaaatactggccgtttacccttattctcaaagaagctcttaatttcttctggtgtgaaatcatgcaggatcagtaggtcgtaaactttcttccaagtccgttcatccattactaggtaagcaactttatccgcttgtttaaggatggcattccgaaaagtcgtataaacatttgattcgttaacgattcgatcacccttagagttaacgtaaattgcacccatatcagttgcttgtttcgacgcgtacgtggtcaatttagcaacgcctggttccacttcaacaccatgtggatacagcttgtaccaacctaaatcgtccgtttgcaaatccaaatcaccattaaattgataggcatccccagtggaagtcattgggccataataatcaatgccttcgctttcagtaccacgcatcttttggttagcgccatgaccacctgcagcaagcacaactgaacgtgccttgatgttgactgtttggtccttttgagcagcaatcacaccgcgtaactttttatcgttgtccaacataagcttctcgactcgagtatccaacataatttgaccacccgcagcagcaaacgccttcgaaactttttgaatgaattcatagctacttgctgaaggtagttcaatctgacggttaatcgaatgttctggcgtttgcgtctgtgctttttgataatgtaaatctgcaaacttactaataaaatcaatggctggaccaatgttatgcaccattaggtcggtcaaagctggatagttcgtctccaagctttcacgagcaacatcttgtgccaacatttctggcgtatcatgattattatcaaaaatttgcgcagcaacatcagacccggtaccaacaacgttagaaccattcagaatcgtcgcgccaccaagatagccgttcttttcaactaagataaccttctgacccattgtcaacgctcgacagccagcgactaagcccgcttctccgccaccaataatgagcacgtcggtccgcaagttttgcgtcttgggggcttttttcttaggaactggctgcacatcaacaccagcatcggttacagccttatctgccgacttaagtagcgcttgggtcatcaccgttgcaccactaattgtgtcaacattgaatgattgttccgtaatgatattttgtttcaatttatcaatgacttggttaaagatccccgacgtttcggaatgctttaatattttcaaatcctcaatcttattatcttgcacgtcaacttcataattgataataccgttgtggcccattgcttggccggtaatttgttttttactcaatagtaaacactcctttgcgtcgcggcgttaagccactggtaactgttacctgttgttcatgatcaataaaaattgcttccgtatgtggcaactgttcgattagttgacgaccacggtttggcccttcaaagtaggccaccgttgataacacttcagctaattctgaccgttcagttataatcgacacctgatcaacttgattttcaaccggataaccagttcgcggatcaaggatatggtggtagcggtgattgccaattttaaaatatcgttcgaagatacctgacgttactatcgttctggcaggcatttcgacctgtagcgctggatagccacgtggcgcttcgggtgcttgaattccaacttgccaacgccgattatcggttagcggattggcccctaatagcttaacgttaccaccaagattaacaatagcgctggtaatgccagcctgctgcaactgcttaacgacctgatcggcaaaataccccttggcaatcgcaccaagatctaattgcatgccagattgacgcaagtagatactcgattgggcttcatctaggataacttcgtgcgtatctaataaggctaatcgttgtctaatttccttggccgctggtacttgatgcccaccaaaaccaatcttccaaagtttaaccaacggtccaattagcacattaaaactatccgcatattgctttgtgtacttaatagcatccgacactagttgaaagcattcagtgctaaccaaaactggatgaataccggcatattgattgatcgcagctaattctgaatcggcacgattgacagaaaagacaccatccatccgctgcaagtaatcatagaccgcttcgaccgctaactgattcggctcaaataatgtcagcgagatgacggttcccatcatcgtaaattgtgaaacatactttttttgtgtcccaatcatcactctgacctcacgatttctttcagttatgctttaatttaacttcagatcttccaattccggccgtaaattttcaagtgcaatttgcccaggtgccgaagccgccccgaccgttgcaaatgataaacaagagccgaacacttcaccagcaagccgtgacacttttcctaagtcacccatcgacattgtgattactggctgtggtagtgtttggcgtgcaatattagtcgctgtcagtaatgttaagacatcctccaccgattgtggcatcacagccatcttagcaacgtcagcaccataatcgaccatactagtaaggcgcttaacgatctcagcaaccgccggcgttttatcaaaatcatgattactcatgatcacaactacttgatgctcatgaactgctgcaacaatttgtttaacagcttgttcgtcatggtaacgctcaacatctaaggcatccgtgaacccaccatctaagaccgtctcacacagtttaaaatactcagtatctgatagtgctaattcgccgccttcacctttagttcggaaagtagttaataaggcaatatcacctaaagcctgacgaagttgctgaccggccgatttcaactgttctggattagttacatccttgaaaaaatcaattcgccattcaacgacatctggctgtgcagcctttattggttcaactgcagctaaaatatccgcaatagtttttcccgtaattggaacggcaatcttaggccgtcccgttcctaattcaatatcacgtaatttaacgattggtgtcatgatcaatcgtgacctccttttgactgttcttgccaaacaagtggtaatagcgaaccgtaatgagtacagccaatacaaatccaatcaacgcaataataacgtcaaacaagaaaatgtttgcaagattagttgacatcatacctgtaactaacggtatcgtaaaggacgcaatcgaccccgctgtataaaaagcaccggtaatcgtcccctttccttgtgggaagaaggtggacatgactgtcaatcctaattgcataaccccaccagcagctgagaatccaacaacaaatgacatgattgaacacatcaaagatgttggtaccagatacatcagtagtaacgagagaaatgaaagtaaggtatagatgcctaagaattgaatttcttttacagcacgtttagctagcgcagccgtcaccagtacacaaacgattgacccaacactataataactgatcagtgctcgtgaacttgcatcgcccatgccggcaacctttgcaccatactgactcaaccattgactaactaagtagaaggttgcctgagatacataaccatataagataaatagcgttccatcaaaccataagctaccctttgattcagattgaactgtcttaccttcctctttcgcagcaactttagcatcctgattagcaactgggaacttcccagcagccaacatgaatattaagttaacaactaatacaacaatacagaagataaacgaccaaccgtaccaataattaccagcaactaagaagctaacgaataacggcaatccaaattgaccaacagaaatgaaggccttgataataacgttcgcagttccttttgaatctggaaacatttccattaatgccggataagtcccagaatcaaggaatgagttcgctatcccagcaagtatcccaaaaacataagccaccgtaattgacgggcttaatagaataccagcaaagaagagcaagtacgtaacaacaccaagaaccacgaatggtttacggccgaacttatctgatagaaatccagaaactaacaaaacaattaaacgaccaattccaagtgatgaaattaccacggcaacaccacctgtagtcgtctgccagtgttgagccaaagcttccatgttttgggctaaaataataaccccaatcccatgaataaaatagtttaaatataagctaatggctgtcggcatatatttatttttcatggcaacccccgtctatttttgtgctgcagcgtcttcatcaaataaaatatggcgaatataatccactggcatatcttcaccagtccagagcttaaaggcagcagcaccttgttcgagcatcatacccaaaccattaaagacatgttcaacgccagcttcttgggcaaccttcattaacttagttgtccgtggtgcgtatacggtgtcgaacacaatcaggtccttacgtaaccaacttggatcatcgactaaagtcttgtcttctaacggcttcataccaacaccggtagcgtcagtataaatatatgaatcttgaatttccttcttaaaatcatcacgatcttctaattcgtgtaaagtagcatggcaggaagtccgctcgttgatcaaatcaacgttatgtttagcattttcccactctgcatcatgtaagttaaagattgacatttcactaactccgtccaaagctgcttgaacagcaattgcagtcccagcaccaccggcacctgctaacgtcatcttatgaccacgaatattaattccttcatcgtccagagacttcataaaaccaataccatcagtcgtgtaaccggttaaaattccatcatcattaacaatagtgttgaccgcaccacacatctcagcagctgggtctaatttgtctagcagtggcaaaaccttctgcttattaggcattgaaacattagaaccccgcatatctaacgtccgaatcgattcaattgctgaaggtagctttttgttatcgatttcgaatgctagatatgcatagttcaatcctaatttagcaaatgcattattgtgcatcgttggtgacattgaatgccgaatcgggtatgccatcaatccaattagtaatgtgtgtccatcaatgcgttcagtcatgttaatccactcctataaatttatatttttaatatttgttactcaattcacttgtcatcttaacaaaatgctttaatataataaatatagaacagttgctaaatcgattaaattcttttatgaatgaaaggggtatcatgcagattgaatctaagacacttagaattttttaaagaattagcacggacacaacatatggcaaaagcggctgaaaaccttggtatctcacaaccttcattgagctatgccattaaaaagttagaaagtgaattgggggttcctttatttgaaccagatggtcgtaatattcgtttaacaccgattggttccgtgtacttaaagtatattacggcaagtttaagcgatttatcacaaggcaatgaactcgttcagcaattaatggatcctgacaaaggacatgttaaattggggtttacttatacacttggacagcagctagtccccgaactaatcactaagttccatacagatgataaaaatcatgcaattacatttgaactcggtcaaggaaactcaactgaattactccaagaacttgctgatgaaaagtttgatttagtgttagcctcaagtgtcgaacgccttggcgagcaacccactaataccttgtttgattttattccattggttcaacaagaaattgtggcggctgtccctagccaccacgcgttagccaaacaagaagaattattcgttaaagacttggaaccatatcccatgatatttttctcacataatagtggtttacgtcctttgattgatcgaattctaaggcaggcgcatgtgaaaccaaaaatcgtttacgaagtcgaggaggaccataccatggctggctttgtgagctataattttggcgttgctttgatgccatacttaccgcttttagaccagaccagcataacgttgaagcacttagccgatcagccactacgtcaccaaatatacctcatcagcaaacgtaatcattttgttacaccttcagttagtcgatttgaagaattcagtcgcagttactgttggcaacattacacacaacaggaacgtttaatttaggacaaaaaactctcgggtttgcaacatgcattatcgccagactagtgataatgcgtgttatagacctgagagattttttactaagcaacaattgtcttcttttctcgcgatagggtaagaactacaatactgcaaagaacaccaattccagcaattaatacgtcaaaccacataatttcataaataccaatctgtgaaatccaagcggtaaataccggaatcgtaaatgaagctaatccactcgcagtataataaattcctgtaatacggcccttagcgcggggaaacgtattactcataacggttaatcctaattgcataacaccgcctgcagctgagcatccaatcacaaacgaactgattaaagctacccaccacgttgggattagcgttaaagctaccagtgctaacaacgataccaccgtatcaaacagcataaaccaaaccggcttaataatccgctcaactagtaaagcagttacaatcacgcctaaaatagaaccaacgctatagacgctgactaacatgcgagcgtgtactaaattcaaatgaatcacgtcactgccatactttgtcaaccattggctcactaaataaaaagttgccattgagatatatccaaaaaccgtcagaacacatccaaggataattttctttggcgttagtggtatatgcttttgcagagtgttctgctttttattaggcattgttactcgattagttgttagtcttggaaaagttcgctgacgtaaaaagctaaagttaactaccattaaacacacacacaataaaaatgcccaaccataccatagttgaaaatgatctagtccagccacgataataggtaataataattcaccaatcgaagcaaacgctttaatcatgatattcgccgttgcttgcctttgaggataaagttccatgagtgctggatatgttcccgaatctaaaaatgaattagccattccggctagaataccgaagaaataggcaacggcaatgttaggagaaatgacaatgccaataaaaaacagtgtatatgttaagataccaatctgaacaaataattttcgaccaagtcgatctgagaaggtcccggctaaataaagcactagtaatcgtccaatacctaatgatgaaataacaagtgaaacaccagcatcattgacatgccattgttgacttaacacagtcatattttgggcgagaatcacaatagccataccatgaacgaggtaattaagatacaaacatatcgttgttttaatacgttctgttgatgtcatatgagttaacctttgcccttgtaaaatttgaattgagtaacaaagtgctttgctcatctattaacataatattttactccagatgtaagcgcttatcaattgtagtttacttaatatatttcaattttttcgaccactcaccgactaacacttaccaagatctgaaccaccaccatcaaagtcgccaaaatatccaacacccagctgctccacacatagtagttctccattggccgatatttttggcgggttaccttgagatttttttcatataaccggttgaagaagataaatagccagataaagaaccacagaatcaggcaaaagacgggataaatgaagatattgctcttgattccccacggcgtcagactggtgacagcggttggcacgtagacacgattaggtagcagtggatatgcgataattgccaataatagcggtaataacgctaatcccgtctgccgccacaaattatagtggccgtgctcatctttaacattaaacattgcgccaacctcccttaattaaccagtgcatcgcaaatggtaactgatgattccagaaccgccaatcatggtgacccggttgtaactgccattcaaactggtctttaaacacagccgccaactctggcttgaaggcttcatccattgaccgtaacatatcttgatcacccgtcgccattagaacacgtaacgtcccccagtttgtcagttgctgtaccaagtaagacaaatccgctggcgtcccttgcatctgtgctggtgagaaagccagctcaaggtctggcataattgccgattgttccacgtgaaaccttttgagatccgtcaccggtgatagtgccgcgacagccgcaaaccgctgcggataggtaaaggcataacgtaatgccccatagccacccatggagttccccaacaaataattgtcttccggtcgtgccgacaacgggaagatataacgcattcgtgttggtaactcgtgggtcaagtaatcccaatagcgtggaccatggaccatattcgtataaaatccccgccccgtttccggcatgacgaccgctactcggtattgcgttgccagtagttcgatttccgttcgccgtaaccacgacgttgcgtccccacctaagccatgcaacagccacacagttggaagttgctgttcaccactactgtagtctggtaaaatttgtccgaccgcgttcactggttccggcaagataacttggacttgcactgactgtcgtaacacgttggaataaaagttattgctatgaattgacattgtgtgccactcctctctttatgcatcgatcatcgaattcggttaggatctaccgacttggaatcactagttagcgccagcccaaaatagttaggcaacatgtaactaacggtatattccagcgtttcttccccttgaaatacccaccgttcgatcttaatcaccatcgtatccagactcacgtgcaaataatccgcaattcgttgattaggaacgcaggtcgccgcatattcttgctcaaagagctggcgtgataaatcaagctgcgcatgtttcctaattagtgcataaatcgaatgtacggcccgtaacttcttcattgctgtggcaggaatcagcgtcgccaaataccacgactgcgaaaattcaaatggtgcgtgtctaatttcgcgtaatcgctctaaataccaggttgtcgattcagccgtaaacttagcccgtgttggcagtggcgtcgtctgattggccactaagattgcaacctgttcctcatcaacatcgtatgtatgggtatccgtaattcgtaccgcagtcccccgattaaatttggaaacaaagctgcccttaccctgaatacgataaatataaccctgatcggctaacatattcagtacccgcacgactgtcgtggaactgacttgatacttcttccgtagctcactctcgctataaaacggatcattctttcgaaaatggttcgtgttcaattccagaatcaaggcgcttaaaatggtttgataaattggctctttacgactcatggctgtccccccttattattaacttaatacattaaatgtctatacttaatcaaaatttacccatatcaattaactaacaacaatgaaagcgttaactatactgttatattatgctatactcactcatgaaatcaagttaatgtgttaacttaaatcaaaaagggaggacttaattcaacactaacttgtcattactaatttgttaaggagatgaatgaattatggataattcacgtacgtggaaagataaaacggttgatgtcatgagtaagatcgcagccaaccgttatttacgtgctattcgagacggaatggccgttattattccagttaccatcgttggctcattctttacgatcgtcacgcaactacctattactgcttggacaaactttattaaaccctatgccgctggtttagcaattccaattaatttttcaatggggtttatggctatttacgccgcgtttgccattgcaggtcgattagctgaagattatcacttcgaccatatttcaaccggggtcgtctcagtgatggtctttctattgttggcagttaaaccaattacgaccaccccagcagctttcaaagcgttaggactaaaagccgctgccaccgtggtgccgctaacacacttcggggctgcggggttatttacagcaatgctcgctgggattctaacggccgaagtgactcggatctgccgcgatcatcacctcgtcatcacattaccagatggagtcccaccggctgttgcagcttcattctcagctttgattcccgcgacttttttaatcgttggtgcttgggtcattcacgttggtttgaactttgacgttaatgctttcctacaatgggtcttcagcccattagcctactttggtcgtgacaatttactttcagttatcgtaccaatcctcttaactgatattgtttggctattcgggattcacggtgctgctttagccaccccaatcttctggccattatggtatccaaacctgaacgataacttagctgccatttccaaaggtgcaactgctgcaacggttcctcacttcatgactgaacaatttttccaatggttcgtctacattggtggtgctggggcaacactgtctctctgtatcttattagcatttttctctaagtccgcttacggtaaaacaattggacgggttaccattatcccaggaatcttcaacatcaacgaacccgttatctttggtgttccaattgtcatgaacccatactttgcaatcccattcgtcctcgcaccgttaaccatggggattatcacttgggctgcaactgttctacacctcgttagtcggacggtagctttagttccatggacattaccaggaccaattggggcgttgatgaccactgcttgggactggcgagcagccgttctatgtattattaatattattgtggccacctttatctattacccattcttcaagatttgggatcgtaaccaattgaaggctgaacaagacgctgctaaagccgatgctgaaaaagcagctccagcagccgttgccgaataatagattgcaccaaaatcacacggatttgtcattacggtatgcttaaactaacgactactttcaatgaacatgattgcttatttgctgacaatcggtctaactttagcgccaaccgtaattagccattatgattatgattctgggaggactgctgcattggctgcagtcctctttgtacatattttaagaaacgagggaaaacgattgaaatctgatattaaccaacttactactgagggtcgtaatcctgccagtaacgacttagacgaaatgtcgatcctggcaattgcccagttaatgaatcaagaagacgctaaagtcagtcaaagcatcacacccgaactaccacaaattgccgctgctattgcccttatcgtcactgcctttaaagctaacggccgcttaatttacatgggcgctggtactagcggtcgtctaggagttttagacgctgctgaatgtgtcccaacatttggtactgaaccagagatggttcaaggactcattgctggcggagctcaagctatgacggtcgccgttgaaggtgctgaggataatcctaatttaggcgcacaagacttgaaagatctggccttaactgctaatgatgccgtggtcggcctggcagcaagtggtcgcacgccttacgttatcggtgcactggactacgcacaaaaaatcggtgcggcaacaatcagtctagcctgcaataatcaggcactaatcagtcaacacgctcaggttgccatcgaagtaacccccggccctgaagttctcgctggttcaacccgtttgaaagccggcacagcagaaaagatggttcttaacatgctatcgacaatttcgatggtcaagatcggcaaagtttaccataacttgatggtggacgttaaaccaactaacgaaaaactcgtgattcgcgcgaaacacatgatcgaactggccaccggcgtttctgccgatgaagccagcgaactattcgctgcagctcatcaaaacgttaagacagcgattgtcatggacttggctggcgtctctgtcagcgacgccgagcagcgtttacagcgcgcacacggtgtcgttcgtgacgcactcgcactgcaatgaggaggtctaaaatgacatatttaattggcgttgactgtggtggcacgcacatcgttggtcaaacttggacgacagcccccgagcatctggtccaaagcgttacgggtggccctggtaacgttgtcctagactactctgctgccgttactaacttaaccactgtcttagatcagctcactgccacaattccagctagtcagcttgggttgattttaatcggaattgctggaattgaaactgctggccgggctgatcaggtccaacaaaccatcacccaacgttaccacgctaatacccaggtcataagcgatgcaaaactggccctactgaacggtcttgcaggagcagacggcaccttagtgattgccggcacgggctcggtcgtttatggccgccaagccgggaaatttctgcgcgttggcggctggggttacgttttaggtgacgaaggcagtgcctacgacattagcaagcgggcacttaaactggttctgacccagactgataacggtcaaactagtcaactaacagctcccctattggcacaacttaaagttaccgatgttgctgccgccgtccagaaattttacgctcaagatcgacaaactaacgctcaattagcacagttaatcgccaaactggccgagcaacaaaattctgaagccatcacggtattagtcacgtcagcccaagcactggcacaacaagtcgttaccttatatcagcggtttgcagagtcccggccacaacgggtcgccctctctggttccgttttaaaacacaatcgcctggtccacgacacgttaacgacgacagtgcaccagtcaataccaacaattgcatttaacgatattacaactaacaacgcccacgccgtcatctattggcaccggtggactcaggaggaaattaattcatgacaatgcgtcaactaggtttatccatttatcccgatcatagcgactttgaagaaaacgccgcttatctcaaattaggccaacactacggcttcactcgaatttttatgagcatgctggaagtatctggtacggtcgccgaaaccaaagctaagtaccagaaaatcattgacgttggaaatcagttgggttaccaaacgattttggacgtttcaccacggatttttaaacaactaggaatttcctataaagatctaaagtttttcgctgatttacacgtcgccggtattcgactagatgagggtttcgatggcgcgaccgaggcgctgctctcgtataatccgtacggcttgatcatcgaacttaatatgagtaatgacgtcgattatctgaataatattctcagctaccaagcaaacgtcccatttatttatggctgccataatttctatccccaagttggaaccgcactaccttacaactttttcgttaagtgtagcgaacgttttcgtaagttcggcattcactccgccgctttcgtggcaagtcaggttggtacgatggggccatggaacgtcaacgatggtctgccaacattggaagctgatcggcgcttaccaatcgccgtccaggccaagcatctcttcgcttccggactaatcgacgatgtaattatcggtaacgcttatgcgagtgaagccgaactggccgcattatcagcaatcaatcggtaccaagtacaatttcacattgaatttgaagctcagacaaatgcgatcgaaagaaccattgccttgaccccacaacattttcgccgtggcgatattaatccaaatgtcatccgttcaaccatgccccgtgtgacctacaaggaaacgcccaacagtccacacgataatgatgtagaatttcagcgtggcgacgtattagtaggcaacgacaacttcggcatttataaaaatgaattgcaaatcgtcttacaaccccactgtgaaccccgaaagaatcggattggtcggattgcacctgaggaactgttactgcttgactttattaagccttggagtaaattccggtttgtggattgaaattaagtttcctgttaaagaatcataaaatccgctcgaagtttggagaagacttcgggcagatttttggtctatgtgcgatcaagccattgatactctactgatttgatcatttttaaaatactaaacttaccggcctcttcgctttgattaattagataatatgtggctcgtcccttgtaaactaatttttcaaatttaaatcaaattcaaggatgcgtataaaatctgcatcggcaagaagatcttttgaatctcaaatataaatcaaaagaattgacagatttacaaaagtgaatcacaacactgattgatgcctaatcactcacgattactattcggtaatggttctgcatgctcacgaaactggactggtgagaagcctgtcttcttacgaaataaccgactaaagtaatgtggatcttcatacccgactttattagcaatcgctgttaccgtgtattgtaatgttaaattacgaagcaactcttgtgctttttgaatccgatactctattaaatattcagaaaatgttcggccatatgtctgtttaagttgcctgctcaaatacccctcatttacaaataacgcacttgcaacctgacttagtgaaagacccttttcagaataatgcgtctcgatataatctttaacattcatcgctagactacgggaagtaccttcatccacaaccgtacgtttatcggttattaagcattgctggaacgcaatcatcaattttttcaaatcagatcgtgggattggttttaataaataatctagaaccttcaacttaatagcgcgacgtgcaaaatcaaaatcatcaaaaccacttataatgacaattagcatatcagggtaacggcgattaatcagttcaattaaatctaatccattcatatctccaaggttgatatcaactaacgcagctgaaaccgcatgttgatctatataacttaacgcttgatgccccccactgacagttattatctcatcaaatggcgattgaattgactttaaatatcccgccaagccacaacgtaatgctttttcatcatcaataatcagcaatctcttcatcacagttcacccccatgttcaatggattcttcaaccaacggtaatattaccctgacagtagtctggcgcctcgtactactaaaatcgagtcgtgcttgaccattgtagatcaactgtaatcggtgtcgaatattataaataccgtaactattttttcccgcttgatagctcccgtcattgagtttttggaccagcttcgccgacatgggctgcccattattgctgaccgttaattgtaatcgtgttggcgatattaatgcaccgccgattcgcaattcattattaccatttggactacatcgtaaaccgtgattaatggcattctcaaccagcggctgtaaaataaaatgcatgacgggttgatccatcaggccgtcatcaatatcaattgatagttgatgtaactttggaaaacgaatcgcctgaatcttaaaataactctggacatgggtgatttcatttcttagcgttgtatactcacatccatggttaagtcccttccggaaaaaaatacttaagttttcaatcatcgtaattgcagtatccgtatcaccacctaaaatctgccattgaattgtatccaatgtgttatataaaaaatgtggctgaatctgcgcttgcaatacttgaatagtcgcctcgcgatatttagtctcattttcataaacgcgatctaaggtctgattaaaggtcgtcgccaaggtttgaatctcttggggaccttcaaccactgctcgaatatcatggccgccgatttgaatttgattcattgttcgagttaagttttcaatcggtcgtacaatttgtcgtaataataaaactaataacaatcctaataaggcgattacgactaaaacgataatcaataataatcgaatgagttgttgtgtattttctcgtagctctttcttctgtacaacataattcaccttccaccgtggcaactgttccagcttggtcgtgagcagtagttcacgttgcggattaattcgtggagaatcagtatcaccacctaataacatcccagtaccgtcatagattgatagctcatgtgcaagggcctccacctttgctaacggaattgcagccgcaacataagccgtatgatccgctagtggtcgtgccaaccgatataaaataataacaatcgactgatgatcttccttggaagttagcaagttactaaccgtatatcctcgttgaggataacgttgcatttctcgatagtacgaccgttgttggacagaaaagcttggatgagaattggaataagaaattccgtcacgtgatacgagtcgaatcgaaacataattgtgcttatcaaatttcgtaagcgctttagtttctttgaataattgttgccgattataatcgtgttgtgccggcaaattagcaagcaacctcagttccgataatcgttctccaaaccagctatcaatttggtttccacgctcgtcaaccatttgttgtgtcatttttgtattaatcggcatgatatttcgagccaattccatacgcatggcaccataaatcgtaccgataagtgttaccgatattaatataaataaccaaacaatttgtttcttaattgaatacatcctaattcccccatcactatccaagctccgtggttctatcatctttcacttgtacattatttcactatttagttataaaagtccaccttatctcctaaaagtccaacgtctaaaatacaattaacacgtatactaacactattaaatatctatttcggaggtcttagtatgaaaaagagatggtggggtatcattttcacaattgtctcaattttcttcttaacagcttgttcagcaagtgataagtcgcaaactgttaatgggaccggcactggaaaacacggcaatatcaaggtagcagttacctttaagggggactctattaaagatatcaaagttctcaagcagaacgaaaacaaagtgttatctaagccggtatatagccagttgaaagatacgattgtcgcaaaaaattcaactggtgtggatgttgtaagtggttccacagcaactagtaaagggtatattgctgcggtcaatgatgcagttaaaaaagcaggaatttcactcaaaaaagtaaaagcaaaaacgagcactacggaacctaagattgctaaaaccaataattatgatgttgtcgttgtaggttccggcggtggagggtttgcagccgcaatcgaagcaaaacaagccggtaagaaggttgcaattattgaaaagatgccgacagttggtggtaataccttaatatctggcggtgaaatgaacgcacctggtaactgggttcaaaaaaggctcggtattaagggtgattctgtagcaagctactataaagatacaatgaagggtggagacaaccttggtgacccagcaatggttcacattctcgccaataacgctttgggatcagccaagtggctccgtgatgatattcacgtcaagtttttaaacgatcaactatttcaatttggtggccacagttacaaaagagcactgattccagttggacatactggtcaggaattagtcaccaagttaaacgctaaagccaaatccttaaatatcccaatttacgtcaatatgagagccaaatctttaattaaaaaagatggacgaattaccggcgttaaagcacagtaccagggtaaacgaaacattacttttaaagctaaaaatgccgttatcttaacaactggcggtttcggttcaaacgttaagatgcgtactaaatacaataaagagtttgataaacgctataagtccaccgatacagccggaacaaccggagatggtatcatcatggcccaacaagccggagccaagcttactaatatgaaatacattcagacctacccgattgctaatccgaaaaccggtatgatttcattactagctgatactcggttcgatggtgcaatcttagttaatcaaaaagggcaacgctttgtcgaagaacttgaacgtcgcgacgttatctcaaaagccatcctaaaacaacctggtggctatacgtatcagatttggaacgacaaaatcgatggtatctcaaaaacaaaagccgctcataaggcggaatacaacgagttaatcaaagaacacctactctataaagcagacacaatcgatgaattagcaaaagatgttaatatggatcctgctgctttaaaaacaacaattaccaaagtcaacagctatgccaaaacaggcaacgataaagactttcatcaccgcgctggcctagtatccttagctaaagggccctactatattgaaaaggccgtgccatctgttcatcatacaatgggtggcctagtgatcaataaacagactcaagtcctcaacactgatggtcagaccatccctggattatacgctgctggcgaactaactggcgttattcaaggttcaaatcgccttggtggtaacgcgatcgctgatattatcacctttggacgcattgcaggtaaaacggttggtaagctttagtttgttaccacaatctatattattttaaacaaatgggatggaaagctgaattcagttttccatcccatttgtttaaaggcttcaaaaagccacgaaaatcataatctatctggccctattatttgtaacaatagcaccaatctttccatcaacaaagctaaattctgtttgccctcgcgaatcgcactttctaaatcagtgacttgctgaactaaagagaaagccgttgtaaagccggctgcctgtagctctggcactgttaacttaatgttaccagcaacacaaagacatggcttatgaaaacgttgcgctctttgggcaacctgaacaggtaatttaccatgtaatgattgttggtccaattgtccttcaccagtaattacaatatcggcggcagcgattttatcatcaagttgtgccacatgactcatcagctgaaaacctggcattgtagttgcacctaataatcgtaaagcaaatccaataccaccagcggcaccatcaccgaccaaccgtccctgatacgttggatctacttgctgcgaaaaatgctgaaaccagagttcaaaatgcttcaaatctaattcagtcaggcctttttgtggaccgaacatctgcaccgcgccactagcccccgtcaaataactatcaacatccgtacaagcaatcaattgtacattttcagtcgcaatgttagataaatcaacatggtcaattaacgctaagctgccaatcactgctggtaataattgatgataactatcataaaatttggcccctagaacacccattaacccaatgcctgcatccgttgttcccgtaccaccaaggcccacaataacttttgttgcaccatgttttattgcagccataattagctcaccagtaccagcagaactagtagtcacggggtcaacaaagcccaaatcagttttcaccgattgtattcctgaagccattgcagcatcaattacggcgatgtgttttgtcgggacataggcatactttgcgtcaattactttgccacaaggatcatgtaccatcaccgtttcccaatgaccatcttcttgattgactaaaaaggccgcactagtaccttcaccaccgtcagccaatgtcacaccagtgctttgaacgccgtagtggttaaacactcgtattgcaaccgttgcggcttcagcactactaaacgaccctttaaacgaatcaatcgcaataagtactttcattgactatacctcaaccactaatgtcaccacctggttaggttttaatattgcctgattattaacagattgttccgctaaatttagctggttgattgacttaggcaatggaatatcttgctcagtcgcgttaaaacatcttaacaaggccttagaattatcttcactaaccttaataacggataccgttgccgctgctggcacaggtaacgaaagttcatattcttgtgctaatgatacttttgctggattcaaatgcatggcctcaaatggaatttggttataggacaccgttggagtcaagtattcttttgccatattagcaacgttggcatcagctaacggttgtggattgattcggataccaaaatccaacgtaatctgccctagcatctcaccatcaggcgttgcagcatgaatccctgatggccgtccagggcgtcgaaataagtcggacttacccagccagttaacacttcgaaacatcgtcatcgcaataattgattcctgtacgatctcatattctcgcgaactatttgtaaatactgatactgtttggtgatcactcaaactaacgttagttaagaagggataaatttcatctggtcgttcatcccagtgatcttgttgccatacgttcagcattgggtcatgtaccggacgcttgatcataccaaattggttgtctgctactgactcagtggcaacaatattcgtgggaactaagactctggtacgctgatccttaacgccattattaattttagcaactacctgcaatgttcgactagctttagcaatggtaataatgaatttcaccgtcattgctttctttgccgaatccgatgcgacacggttattcaaatccttcggcaacatcagcgtataaccaatcgttgcctgataacttaagggacgttcatcaatttgaatattagcgttcttaactacatctgctgaatagattggtttatcgccacgcaatggcgaaaaatcgtattcatcaccatcatctgcttgattttcaacgttcaacactcgttcatacgtttgttgtgatgctttatcaaggattgtcattgtcccattactattaaaaataatatggtaagcatcagtctcaaccgttttagctgacttcgtatctgccaatagtggctgttccattggtacaatggtaaaagtttcatatccccactgcttttgtgaccaattcaattcaatagtaaattggttaaagggctcatagtctccatgtgcaacaatttgccgatcaatcagcccggcgtcaatcttttcacgtttaatcacgtgaaaaggaatcgcgtgattttgtgcatcatgaatctgaaaaccactagctttagttactatcgtcgcttgaacataatgactttcacggtttggcaataaattaaagagtgtcaatttgtccttgtctgagttaaccttaactgccatcgtaattttgcgcttataaaaatcaattaacacatcaacacgctcttcagcaaccaaataacgacccaagatctcccggtttaccttatcggagacacagcccccgatactatcatgcgcatgatttttcattaattctttccaaataagttcaattaaaccatgttggtatggaataccacatcggtaggccaatgttgccaacggttccaaaatatttgtgattttactttcaattcgggcattgtaggatttcaaatccattcttaccgaataaatactacgatgaattcgaccatttttgccatctagcatttcaccgctgacagttggtaaatcaggctgtttctgaatggcatcgaagaacttttcatacgtactcaatgagaagcgacggtccggatacagttgattcaataactcaataacttctttaatattttcctgaatcggcatttggtcatgcccattgggaattaattcatcttgaccatttgcacgctcatctagtacatttaaaattttatccatccgctttttcagtgcttcagcatcattttctaaatacttaccagctgcatatcccagcggaaagttggcagttaagacttctgaaccatcgtcagattgccatttgaattcagaactttccgttcctttacgattcgaaagacctcgccagaataatgagcgccgaataccaaattgattaagaagcatcggcgtttgtgcactctgtccaaatgaatctggaacatatccaatcatcatcggcttgcccaactgacgactatctttcattccatatagtaagtttctcgtcatggactctgcaccgataatcgcttcatccgtttgggtataccaaggaccaaccttcaagcggccagcctgcacaagtcgcttaacgcgatcaatattatctggtttagccgcaaagtaatcttctaaaattgcagtctgaccgtccaaaacatatgcagggtaatcaggatgttgctctagcatatccataatctcatccatattgttaactagcaatacttgtgactcttctgtagaaaaataccattcccggtcccagtgcatgtgagggacaatgtgaatcttatttggtttcaatataaaaactcccttttaatcccgtgccatttttttatttaatttctgcttacgtaacaaaattaataagattgttgaaatcaacgcccccaataatgcggctcctaaccagatcagggggttcattaacccgccaataccgccttttaataagaacattgagaaaattccagcccccggaacattcagcccgattgcatagtaagcaacgattcctcccgtgaccactgatccgacaataaacgacccgattgctcgaattggatctgccatagcaaacggaattgccccttcagtaataccagctaagcccaaaatccaggtttgatttcccacttgtcgttcttcatctgtaaacaagtcttttcgtaataaacaagcagctgagatggagaacgcactcaccatcttgactgaggcaaatacacagtaaggtacaaaattaccattggccattgcgccaagacaaaatgcgtaggccgctttattgaccggaccacccaagtcaaatgagaccataccaccgattacagctcctagtagtaaggcattagcaccggccagaccgttaagccaattaatcagggcttgatttaaccaggcaaccggctgcccaacaacaaagagcattagtactgctacaatcagtgttccaataaccggataaacccaaaaagtaatcacgccagcaaacgcaccgtcactatgaatatgctttttcatccacttcattagatagccggcaagcaatccagccaacataccacctaagaagccactcgcaatagtgtttgccgccaaaccacctgcaaatcctggcccaagtgctggcttgtcagcgattgaatatgccatataggccgacagtacaggaaccatcagtgtccctaacatattacttcctagagtctttagaatagctagccaactcttcggatcattgatcatgctttgaagcccaaaaccttgggcaatcataacagcaattgcagaaatcatcccaccagcaataataatcggaataatatatgaaataccagttaacactgaatccttgatctcagtccaaacactggtccgatcatcaattggttcatcgtcaattttcgactgattttctggatgataatcatgggccttattaagaattttatctaaaacagcatcagcatttttaatcggttcggcaaccgggacgtcaaccatcggtaaacctttaaagcgttcaagatccttaagccgtacatcgtgggccagaatcaccccactcgcgcgcttgatctgattcatagtgattcgatcttcaacccctttagccccctgcttctcaacatgaatttcaatgttacgtgcagctgcagccttgtttaaagattctgcggccatatacgtatgtgcaataccagctgcacaggctgtaattgccactaaggattgttccgttgttgcaactacctttgaatcaccattattttctaaccctactcgtgctcctaataattgaaagagctcaccggctgtgcttgccgtcattaattgatttcgataatcaacatcagctaaacgagtggctaattccgatagaatatccaaatgcgtagtccccgcctcagctgttggaatagccagcagaaaaatcaactgaacctgattgttcggttgcaggctttcatagtcactaaccggtgcagcggtcttaagtacggtaaacgccgcttgtttaactgtatctgacttgccatgtggaatggcaataccattttcaagcccagtgactgactcagattcacgttcataaattgcttttaaaaaggcttctttggatgtgattttccctgcttgatagagtttctcagtcaaaaagctaaatgcttcctgcttagtggtaatgtccttaccaaccgtgatcaagtctagcgatgtcgctttggttaagtccattttagtttcctccttttatttcagagttatcgtaccaccagcgttgtaaccgcattcaattattgaaataaataaacaccatctgcaacgcaagacggtgttttgtgtatttttacacataatttctaaaatatcggtcaaatagtgccttcataataataaataacggcgttttatcagttaaattatatccacgccaagttttcggttccgaataactgtataacgcaatacttgctaaactggctaatgaattaacttgcaatcctgtcaatgaaataattttttgccgattccgacgtgctgcttgggcaacccgtaaagtctgtaatgtttccccgctttgactgatacagaaaacaaccagattggagtcgttctcaatctcataaataatttgattttcataagtgacgaactgggtcttttggtctaccgcattaaaaatatcagcaaaattttgtgcaacataagccgtttctccaactgcaaagaaaagattctttttagccgtcattagtgcttcaatagccgtgtcctcacgatgttcatcaatcaaatcaaagttgcggttgattatcgcttgctgcaatgattgttcagattctcgctgatcatttgcatgaccatctcgtagtgatagctttaacgcgacaaaaccgtcgtaacttaatttcttacataatcgggtaatcgcattaggtgcaacatatgtctttgacgccagtttactaattgacatgtgactaaccgtctcttgattggccttaatgtaactaataattgcttcctcagtttcattaagtttatattcagcatttagtacccgctgatcaaaagtaatcatagctagtcccccaatcagatcgttattgagataaaacacttatatcaataataatcatatagtttaaatatagtgatagcctaccatacagatagttattctcaaaatatgaagcgatcttcagcccatctattttgaaacatgttagttagaaaaaagtgctaagactatttaaaatttaaatagtcttagcacttttagtttaatccaacttatcaaagcaaatttctgaaattcacatgctattttaaactgggtggatgctaacagtatcatttcccatcagttgatcacaccagcggcaagtcagttcttataccacgtaaatccaccgtcattaaccaattaagctagatcttcaccattagatttaatgaccttctgataccagtagaatgaatctttcttatagcgtttcagacttcctttgccggcatcatcctggtcaacataaataaaaccatatcgcttggacatctctgaggtagaaaaactaatcaaatcgattggcccccacatcgtatagcccattagttgtacgccatcctgaactgcagctttcatttgcgcaatatgtttacgtaaatagtcaattcgatacgtatcatgcacttgttgatcagttgttaattgatctagagcgcctagcccattttcaacaacaaataatggcttacgatagcgatcccacatctcattcagtgtcactcgcaaccccaccggatcaatttgccaaccccaatcggattcctcaaggtaaggattacgaccaccagtagccatattaccgttcacttgttcaggcgcatcagcttgagttaccgttgtcatatagtaactaaaactaataaagtcaaccggatacttcgctaaaatcttctgatcatctggtgccatttgaagttgaatatcattctctgcaaaaaaacgattcatgaattctggatattccccccgagcttgaacatccgtgaagaataagttcttatcgtcttccacttgagcagcctgaacatctgcaggattaggtgtcgctgggtaagtttgcattcttgccagcattgacccaatcttagcatccgggtcaatagcatgtaattgtttggtagccagtgcactagcgataaattgatggtgcagcgcttggtaacgtaactgcatctgatcatgcgttgaatcctcagtatcaacagctccggtggcatgaaacccccaagttccggtattaatttcattaaaagttaaataatacggaacgcgacctttaaaatgtttaaaaacaacttcagtaaaccgattaaaatcggcaatggttgcccggctggcccacccattttgcttaagcgttgatccaatgggcatttcataatgtgatagtgtaactaatggttgaatgtgatggcgtcgtaattcatcaatgactcgatcatagaaagcaagtccgtctgaatttggctcgagttcatcaccttttggaaataatcgcgaccaagcaatagagaaacgataaactttaaatcccatctcagcaaatagtttgatatcttctttgtaatgatgataaaaatcaacacctcgacgcttaggatacattgtatcagtttgatcatctagtgccgtttgaattgaagatatcgttacatcatccattgacatatgcttgcgatccgtcgtttttttcactacttctgccgttgtcaggcctttacctgcttcattccaggcaccttcaacttgattagctgctgtcgctccgccccacaaaaagtctttagggaacgttttaggataagttggtttatacattagctggtgctccttccatgatctccttaggttgtaattctaaaatccaattatcactagcctccgtcgcatcagttggcttgaccatttgatagtcagccgtattcgtaataatgaccatgacagttgtatcgtaaccagccgttttgatcttatccacatcaaatttagttaataaatcaccacgtttgactacttggttttgcttaaccattgtttcgaagtattgaccatttaattgaaccgtattaataccaatgtgaatcagaatttcagcaccactattggccgtaattccaatcgcatgaccagtgggatatactgccgtaattgtcccatcaacgggcgctgtgaccgtccctttatttggaacaatggctaatcctttgcccattgcttcagacgcaaatacttcgtcatgaacactagtcaatggaataattgtcccttcaaccggagccattactgtgttatcactttgatcacttactactgagtgatcagcctgctgttgacgagcgaatccaaagaagtacgttaagatcgcaccacctaagaatgctacaatcaatccaatgacttcacccataaacccatgtcctagaaaagttggtaccgctaataagctagggagtgtaaatgagctagcgtgcgtaccagcggcgccaataattgcaccaccaagggcaccacccacaacggcacaatagaatggtcgttttaacttaagcgttaccccgtaaatcgtcggttcggtaattccaaacaatgctgtgacaaaagaagaccctgctaatgctttcattttttgatctcgtgacttcaaaaaaacagctaacgcagcaccagcctgtgataatacggccgcactaagaattggtaacaacgggtcataacccatcttagcaatattattcatcatcaacggtacgaacgtccaatgtacaccaaagataacaaagacttgccagaaggcacccatgataacaccagcaccaattggcatgaagttataaattgccataacaccacttgctaatccattaccaatgagtcccccaattgggccgacaactaacagcgtcaatggcaccatgataattaatgaaaagaggggcgtgaaaatattccgaattgccgctggaaatagcttgtccagtactggctctaaatacgacaatacccaaactgccagcagaattgggataaccgttgacgtgtatgttgttggaaccaccggaataccaaagaaatgtagtgttgttgaattcgtcataacagttactaaagttgggtatagcagagctgcaccaagtgacaccgctacaaattggttaaccttcaactgcttagcagcagtaaatgctagaaaaacaggtaaaaagtaaaaaatagcatcaccagcagaataccaaatcttataagccccactagtcgttgacatccaattaaaagcaaccgctaaagctagcaaccctttcaaaataccagcaccagccaaagcacctaaaaacggcgtaaagattccggagataaaagcaataaaccgattaatgatgttttgcttttcacccgtatcttccgttgtagtagctgcatcagccgccgtatcaggatttgctaatcctgctaaatctgctaaaacggcaaagacctgcgccacagcattaccaataacaacttgatactggcccgcgctttgaacaaccgtaatgacaccatctaagttttcaatcgcctcagtattcgctttgtccgttgactttaagttgaaacgtagtctggtcgcacagtgccatgctttgctaatattatcttttccaccaatattggtaagaattgattgtgctaattctgaataatccatacactttttcctccctttataaaacgacaaaaacccaagtaggcccgttatcaacactaaaaacacaggttgactggttgctacttgggttttgcctaatcgaatagttacaatcccaaaaatattattgattctcgttcaacatccgctgaatgtgcatgattaagtaaatacgctcattcaccgaaacagtctgttccgtcgacttcttcacaaaaacagcgattttttggacacaggcaaaggctcgggggtattgcttagataaatgttcaaataagaaatcatcatctgccccttgggattgatcaggtcgtttcagcgttaaacgctccgcaaaaaagcgtagatgaactaaaaatcgttgcaaactaacactctcatctggcatcgttaatgacagctgatacttaacaatattcaaaatatcattaatcaacttagtcattgcaagtgtttgatcagtgttagagtcagccatactattctcaacaaacttcattgcaataaatccagcttcatcttccaacaacgtcacatcaaaatgctttttaatcagtgccaatgcttgcataccgacttgaaactcacggtgataaattcgcttagtttcccacaagatttcattatgaatatccatctgatggtggtgccgatagacagcaaagtgaatatggtcagtcaatgaaatcaacaaataaacattaaaagtcgtttgcaattgttgttctgccaactcaataatttgcgaagcaacttcaaaatattccggttcaatatctgccatcaagctttggaaattactaatccaattatctccttctggcgtataaatcttagtaatctgttgttgctcaacatcgtcaccagtatgctttttgaacccgattcctttaccaattaagacaacttcccgtccatttttttcagccaataggacgttattattaaaaacctttttgattcgcatgcgcacgctcctcgactctcatacctaaataaagaaaaaaacctaataacccactgcatccgtgctatcaatcacgaatacaatcgattaattaggttttgcccactagctaatgttagcggtaacaatccttatttacaattagctagtatagcggtttcggaaaacgattgcaagcgttaaatgtcaatttctatcatctcagcaatgatatatcgctgttagatatcactaattgcatttcaactattcagatttctccgctaacccattatgcttaatcacatcttgataccagtagaacgacttcttgggatagcgagctaacgtcccgtggccctgatcatctaggtccacgtaaataaagccataccgcttactcatctcgccagttgatgcactaacaaggtcgatgcaaccccatggtgtgtagcccatcaaatcgacgccatcatcaatggcaccagccatcgcttcaatatgttgcttcaaataatcaatgcgataatcatcttcaacatagaaattcttatcaggtttatcaatcgcacctaggccattttcaaccacaaacaacggtttctgatagcgatcatatagctcatttaacgcaatccgtaacccggttgggtcaatctgccaaccccagtcactcgccttcaaaaatggattcttgacgccgcccatcaggttaccagcaacagtatcggttacactacccgtggtttccaccgcgctcgacatataataactaaacccaatataatcaactggatattgttgtagtaatgccaagtcgccatccgtggtctccagatcatcaaaggtcagatcatattcagccagcagtcgcttggtataggtcggataagctccacgtacttgaacatccgcacagaagaagttgaaatcttgattatgctgcaaattagccagctggttaactgggttcgaatcataagcataactagtggcatagagaatcatacagccaacctgaatatcgtctcgcaattcgtgggcgattttgactgccttagcactggccacaaactgattgtgccatgcctgaaaaacgttctttttgtcattagcacccgtcgatggcactaatccttggcccatcaccggaaaatgtgccgcactattgatttcgttgaaggttatccaatacttaacctttgaagcataacgcgttaagatggtccgcgcgaaagtttcgtagaattcaatcaaataccggttcttccagccaccataccgtttggccaagttcaatggcaattcataatgtgagattgtaatcactggttcaatattattggccaagcattcgtcaatcacatcatcataaaactttaatccggcttcgttaggttgcgtttcatcaccgtttggaaaaattcgtgaccatgcaattgagaaacgataacacttgaaacccatttcggcaaacagtgcaatatcttctttgtaatgatgatagaaatcaataccttcatggttcggataggtgtacttatctgtatcgatcgtccagtcaaaatctggttgactaacgattttaaatcggtctttgccacctggtaacgcatccgcaatcgataagccacgaccaccttcttggtagccaccctctaactgattggcagcagtcgcgccgccccatagaaatccttctgggaactctgacatttaatcaacaccctttctagttagctaataatgatagcccttacaacaagtataatcaatcattggtctgaatatcaattattaataactatcccaaatcttccccattcgaagcaattactttcttataccagtcaaatgagtctttcttcatccgcttcaaactaccattaccttcatcatcttgatcgacatagatgaagccataccgcttagacatttcggatgtaccggcactaatgacatcaatgcaaccccaggtcgtgtagcccatcaaatcaacaccatccttgactgcttctttcatctgttcaatatgttgacgtaagtagtcaatccgataatcatcatgaatcttaccatcggcgctgatttcatcttcggcacccaagccgttctcaacaacgaataatggtacccgatagcgatcccagaactcgttcaaggtaatccgtaaaccaactgggtcaatctgccagccccaggcactggatttcaagtatggatttttaccacccattgataagttaccactggcttgttcaacatcatcagtcgccgaagtaatcgtcgtcatatagtaactaaaacttaagtaatcgaccttgccttcagctaacaattgttcatcgccagctgccatcgttaattcaatcccgttttctgcaaagtaccggttcatatattctggatattcaccacgtacctgtacgtcagtaaagaacaaattcaattgatcttgcaattgggccgcccgaacatcagctggattaggcgtattggcataagtttgcatccgcgcaagcattgagccaatttgggcctcaggatcaatctcgtgacactgcttaactgcaattgcacttgcaacaaactcatgatgtagcgcttggtagcgtaattgcatttgatcatgtaagcttagatcactatcaattgcaccagtaccagtaaatccccaagttgaagcgttaatttcattgaacgttagccagtacttcacaacacccttatagcgtttgaatagcacttcagtatagcgagtgaaatctgcaattgtcttgcgacttgcccagccattattcgttaatgttaggtttaatggcatttcatagtgggaaatggtcactaggggctcaataccatacttgtgacattcagcaaaaacattgtcataaaacttcaaaccagcttcattaggttcagtttcatcacctttaggaaagatccgagcccatgctaaggataggcggtataccttgaagcccatttccgcgaatagcttaatatcttccttgtagtgatgatagaagtcggcgccacggcgcttaggatagagcttatccgtttgatcatcaatggcagcttggacactctctttagtaacctcgttcatcgacattactttgcggtcagtagccttctgaacaacttcagcagttgttaggcccttcccatcaacgttccaacccccttcaacttggttggcagcagtcgcgccgccccataaaaagttctttggaaagccagttggcattgtttttgaatacataattgaaaactccctttaattagtttaattgtaataatggttcagttgcattaacttccgtagcagctggaaaagccagtttaacgtcatgatagttcttagaattagtcacaaccattggcgttgtaacgggataccctgccgccttaatcgcttcaatatcaaacttcactagcggctgaccagctttgaccgtctcgcccttttgaactagcgtttcaaaacctttgccctctaattcgacagtatccattccaatatgcatcaagatttcagcaccatctgttgtgtttaaaccaacggcatgtccagttgggaacacgagtgctacttcgccgtcagctggagcgtataagacaccatcagttggttcgattgcaacacctttgcccattgcacctgatgagaagacctcatccttaacttcacttagtgggatgatttggcccgtttcggggctacttaacttagtggccgcattgtaagtgacgtttggttctactttagttgctgcaccagttggtgtcgtttctactgaaacaccaccggccatgactggatcagccgttgccgcagtttctacgaccttagtttgcttgtcattactatcaacactcttgtaaccaaataacatttgtagggcaaaaccaaggactgcagcaatggccatcgcaataattaagccatatacagagccgtctaccccagttttagaattaatcgcagctgggattgagaataatcccataccgcccatcatatacatttttgtacctgcaaaaccaataataccgccaccaattgaagcggccacacaactcagaataaatgggcgcttacgtggcaatgttaacccataaatggcaggctccgtaacaccgaaaataccggagataaaggctggtaaagcaataccgcgtgtcttttgatttttcgtttgtaatagaatgcctaatacaactccagtttgggcaaacgaagcggctaatgataatcctaaaatagggtcaaagccttgtgaggctaggttggccatcataacagctacgaacccccagtgaacaccaaagataacgaaaacttgccagaaagcacccatcacaagcccagcaacgatcggactgaagttatagattgcaacacacactgttgaaataccatcacttaaccaacttgcaactggtccaataattaaaaaggtaatcggcactgcaattaataacgtaataaatgggactaagaacgtcttaactaccgttggcacgattcgttttgcaaatgcctgaactttagatgcaaaccaaacggccaagataattggaattactgaagaagtatagctcatcatcacaaccggaatacctaagaaagtcgcgtgaatctgtgattcaaagatactaccactgaacaacgtgcttaatactgtcttactgctgttcaaagcgacaatacttggataacaaagcgccatcccaatcgccattccgacaaattgatcaacatgaaactttttggctgctgtcaatcccaaaacaattggtaggaaatagaagaaaccatcacctatcgagtagagaatcttgtatgttcctgaattctctgacaaccaattgaacgcgacaaacatcgcaacgaaccctttgatcatcccagccgcacataaaacacctaacatcggcgtaaaaataccagaaatcaaatcgatgaaccggtcaaagatactcatcttttccccgtcttcataatcatcaggtacactaccaccatcggcaaaaccaccgacgcgaatgagcgtttcataaacgtctgcaacttcatttccaatgactacttggtactgaccaccggactgaacaactgtaataacaccatctgtatcttttaattcatcagtatgggtagcgctttcatatttgagcttaaaccgcaaccgggttgtgcagtgaaccacgctcttaacattatccttacctccaactccggcgataatctttttacttaaatcttcataagccatcattgttcctcctcatttatctataaatcaataattgcaatttgagtaaacaaaaacccaaatgtcctttcttcaaaccacgccactagggccctagtgactgctgctctcaagaaaagatatttgggttaatgcctgcataaccagtaacacaccgttaataatcttatttattcacttttttgtcggtgggtgacgcgccagatgtgaagggtcaaatagactttgtcatccggctctagtcgccagccagccttactttgtaaaaatgtatcgatccgttccactgttgcataggcatgcgcatattttacttgcatcaactgcagtaatgactgatctaattcactgccagttccattactgcggctaacgcgttgcaccattagcgcacgtaaatgcgcaatgaaacgattgtaattgaaggactctgggtccagatgcatctggtattgatattgcacgatatcaatgatgccactgatcaatttcgtgattttaatcgtttcctgcaacttggaaccatctgaaccagcattgatgaaatgataagtcataaaaaccacttcacttttaggaaggatcacgtccgccgtcacattaattaaatcgaccgcttgactggctgcgtgaaactccttaggaaacaattttttaacttcccaacggactgtgccgttatcgacatcgattccatcattggctcgcttcaacgcaaaatcaatgtggtctgcaagcacaaagtactgataatcactaaaactgaccttcaacagcggctccactaggtgaaccacctttgttgtaatcacaaacgattggggttttaaatcttgaaaagcgtcaatatcaacattctgtttcaaagttgccacaaaacgccgctgaattttctgatcatcaatctgatcaccctgatgcttaccaaaacctacgccattaccaattacaatccattcaacatcctgatcgtccaccactaaagcggcattattattgaagttctttagaaatttcaccactcacgcctcttggattttcaaacaaaaaacctacttaaagagtatcacatctcactgaagagactgtgaatacagatatgagtaggtttatgcctgatcgaatcagtaacacgctttaatttatgttatttatactagcaacaattgtaagcggtgtcaaccgcatgtgaatatttttttgtcatacttccatctggtcaattcgctataatccttcatcattcgctacgggcaccttgcaatacatcatattcttttccagccactaccactactaacggtaagccagtgacaagcttaacttgcgttttatcttgatatagttgaacttctagcactcgaccacgaaaacgcaaccgataactaagatgcgttatctgagttggtaaatgattggtaatgtgtaacttaccgtcagcgacatacatcccagcaaatccatacgttaatcccaaccaactgccgcccagatttgcttcatgaagcccatctttggcattaccttgtagatcaaccaaatccattaacgatgtatccatataataactgaacgccttatcatgatcacctagtcggctcgccaaaatactgaaaatcgatcgtgataaagaggaatcatgcgtcgtaattggttcatagtactcgtaatctcgccgcaattgttccagtgattgatcttctggaaacaacatttccgctaataacgtatctgcctgcttgttgacccggtgacgatagatcatgagcgggtgataatgtaacaacaatggatattgtgttgctgccgtcgtcgcaaaaggccataccggcatctttggtgaattatcatcttgtgcagtgacttgttgttcttgatcatacggtaggtacatgttcgtacttgcctttgtgaactgtgcttgctcatcagcatcgccgtcaatataatgattttcaagtaaccaagctgcaaaagccatattttccttagccatccgattcgtgtagtaattattatctaccaaggcggtatattcatccggccccgtcaccttgtataagcagaattgcgaccggccatcacgctgttgccagctaccaaactgcaaccagaaacgtgcggtttccaggacaactgctgcaccttgttcccgcaagaagttctgatcattagtgacatcaaaatataacttaaccgtatgcgcaatgtccgcattgatgtgatattgcgcagtgccagcaggaaaataggcacttgcttcttcaccattaatcgttcgccatgcgtacaatgcgccccgtgtcacacccaagctccgcgcccgctctcgagcttgcggcaaaatactaaaccgataatgcaacagttgcttggcaatttgtggctgcgtataaatgaagaacggtaacatatacatctcggtatcccagaaataatggccctcatagcccggtccagtaatccctttagctgcaatgttcgttaacccgttacgaccagctgattgaaataactggaacaagttatattgaatcccagtttgtaactttttatcactaatttgcacttgcgactgttgccaaaagtccgttaaaatctgccgattacgagccacaatatcgttggtccaacccattatcttatccggcaacgcttgattaatttcactgatttggcgcgtaaacgaccagctcagcgttgtctgtacttcgatggtaccactgccatgaaaaccggcatgatcgccatatacttcaaagcctgtcggaaagctggtcaaccaatcccgttgcgttatttgttggtgtgttgaagctaccaacgtctgccactctatttgctgctgacgatcagctggtataaattggttggttaacccagattgtcgttgcgccactcgcggatcgtccgcgtccgccgtcgtcgcagttacatcatgaataatcggccgcgtgaaccgcaacgtccccgtataatcaagcgaagtcagttcgtagttcaagaatagttgatgcgaattatccaacgcaatcattgatttaacgaccagttcaaaatgatggtggtcggaggtaacaatctgaaacttttccgttagtacgcccgtatcaaaatcaagcacggcatcgtcgaccgtcatatcccagtcaccaggaatctcagaacttgtcttctcagttgcaaagtctaagtaccgcgggcttgttaatgaaataatcgtttgatgatttttcgcatatccataggcactttctccatatgtgattggattcgtcgcataatagccattgatgagcatcactggtagtgttgcttgttgattacctgtaaacggtactgagtcccgaacacccatgtgaccatcacccaaggcaaaaatcgtctccagatactgccgattcgtcgttgacacatcttttaatgttaacttatcaatttgcatagtctcccccactttcgacttcatttgctgtagtatagcatccgaaataaagcggtttcatcgatttgagaatcactttgctgcttttcgcataaaacaatcgcttagtaccgacaatatactaacgttaatgagaacgtatttaaagtgacggaataatctcgttgtaaccaaaaagcttcgctgacctgacaatcaagttctcgattatcaggtcagcgaagctaaaattatttctcagtacgcttatatagttgcaacactctcacgttcaaccaatgtgactgggactaaccgcgtggcagatttgccaaccaaacaattaacactttcaataccaatctggacaaaattctgggtaacacttgtcaacgcaggagtcgcaatatcgcagatgagcgttccatcaatgctgacaacagaaagcgccccaggtagcttcacattactctcctgagcagccttttgtagtccggccgccgtcatatcactagctgcaacaaccccagtaatgcccagctcttgataagcattaaaaacattataaccagcctgataactataatctccgggttgcacccattcagcttgcccatgaatcgaataattttttaacgccgcttgatacccagcaagccgttgactacctgtatgataatggtcgattccggctaggccaattgtccgatgaccatgcgaaattaaatactttgtcgccaaataggccgcctgataattgtcagagctaacggatttgacgcgttcatctgctagattgatcgaaacaaaacaaaacggtgtctttgattctgttaataattgtaagtctgctttatctggttcaatcgccattaacaaaatacctgaaacagtacgttccaaggcggtcacaattgcttgatgttgtaactcggtattccgattaccagcatatagaataataacctgtaacccgatctcagtcgcgcgctgttgaataccatcaataattccacttgaaaaattcgtcggcgtgacgttgacaataacggcaatcacgtccgtcttctttttaaccaattccatggctagtgtattcttccgatagccgagattcttagcaacttttaaaatacgctcctgagtcttgtcgctatatgtaccctgttttttcgccaacactcgtgacactgtagcaattgaaaagccagttttagcggcaatatctttgattgttggcttcatttttccagctcccctccgatttaaattaattatagcgctaaaagccggtaaaatcattgccaaaagcgtaaacgtttactttattattaaaacggtattgtaaacgtttacgttaagtgctagtattgccctgttgaaaagtgattaacttttaaggagatggattctcatgaaccaacctgcagtacacccgaataaaccaatcgctgatgtttccagtaagcctaagacatctactattgctaattcgctgcccaacctcccattaaaaaccatctttgcaattacctttggtttttgtggggttaatatggccttctcattacaatcatcacagatgagccggattttccagaccattggcgctgatcccaccaaactaggactcttcttcattctgccgccattggctggattattcgtccaaccactagtcggtaaatactctgatcgaacttggacgcgctttggtcgtagaatgccctacttactattcagcgcaccattagcggcgttggtcatggtgttattaccaaatgctggttcattcggctttggctacgcttcaactgctgcattactatttggtgctattgctattttatttatggatttatcaagtaatgtttgcatgcaaccattccgcatgattattggagatatggttaatgaaaatcagaaggacaaagcatggtcttggcaacaagctttcagtaacctaggaggcgtacttgctactattctaccgttcgtcctaacttactttggtgttgcaaacacggcgcaaaaaggcgttgtccctctttctgtaagaattgcgttttatattggtgccattattttattaggcatctcagcatatactattcatacggttaaggaatatgatcctgacacgtacgcactttatcatcatatcgatcctgaacaacataagcacaccaaacctatttggcaattagtaaaagaagccccgaaagctttctgggaagttgccctcgttcaactatttgcctggattggtattcaatatatgtggacttatactactggtgctatcgccgaaaacgtttggcacacaactaatgctgcttcggctggctatcaagctgccggtaattggtatggaatcttgaccttcattcaatcaatggccgccgttctatatggtttcttagttctttcacggactaatccatacaagcgaaagttttggtatcgctttggcttagctagcttcgcagttggcctcgtttgggtattcttcattcacaaccagtacctattaattgccccattctgtttaatcggtatcggcttctttacggtgcatgtcgagccctttaatatctttacttcttcactagatggtgccaatgaaggctcatatattggaatttttaacggtacgatttgcttgccacaaattctcgcatccgttgccagctttatggtctttaaattcgttggtaattcgatgcctggaatgatgcttattgctggtatctcaatgttcatcgcagtacttgccattagtattattaagcaagacaagcctcaagaagatttgtcagagaatccaactaaataaaagtcattttactaaggagtgttttttaatatgagtgcattaccaagttacacacagaacggccaaacgatcacgtttgctttcgcccaaccattacaattaactattgttacgccggaaatcatccgcgtctttattaatcgcggtgagcaaggtgaatcctatgcaattgagggtcataaaattcaggcgactgatttcactattgaaagtgctggtgatcattacattatccggacatcagctttaacgattcacctcgattccgaacggcatcttgatacctttgataaagatggcaatgccttgattaccgattatcgtggtgaacgcattcacttgaaaggcgtcgacaaagtccatgaacgattagttgaggcagaaggccattcagtgactaaggcacctactaaatctgatcaaggttactacgaaatcattaaatcgctagcacctgatgaatatctttatggacttggtgacaagaccggatatctgaacaaacgtggttttgcctatgataattggaacgttgataaccccgctccccagctggagatcctacctaatatttacaagtcaatcccagtgatgttggggctaaaaaatggacatccttacggtatcttcttcgacaatacctaccagagccatttagatatgggtaaggaaagcaaccattactacttttattcagctgtccaaggtaaccttgactactacattattggtggtaccacgttaaaagacattgtcaccaattacacctacttaactggtcgaacgccactacctcaaaagtggacgctcggttaccaacaatcacggtggggttacagtgctagtcaagaagaagtgcaagcaattgcagataaccttgcaaagtacgacttaccatgcgatgcgattcactttgacgtcgattacatggatggttatcgggtcttcacctgggacaaggataaataccagggtaatcccaagaagtttattaccaagttgaaccaacagggtctcaaggtcatcccaatcatcgatcccggtgttaaacaagattctgactatcacatttatgccgagggtcttaaaaaaggctatttcgttaaatctgctgacggtgatgtctatattaacaaagtatggccaggtaacgctgcttttccagacttcggtcgtccagaagttcgtcagtggtgggctaacaacggtaaatttttaactgatttaggtgtcgctggtatttggatcgatatgaacgaacccgctacgttcgaaggtccgattccagatgacgtggtctttaatgatcaagacacgtcttcaacacataagaagatgcataacgtttatggccataatatggctaaagcaacctatgctggactaaaagagcaaactggcaaccgaccatttgtcatcacacgggcagcttacgccggaactcagaaatactcgactgtttggaccggtgacaaccgcagtatgtggccacatatccaaatgatgatcccacaactctgcaatctaggattaagtggctttagttttactggaactgacattggtggctttgcctcagacacgacatctgaattactgacacggtggattgaaggggcaattttcagtccactgttacggaaccatgcagcattagggactcgccaacaagaaccatgggcatttggcgatccaacgttaaacatttatcgcaagtatctcaaattgcgttatcgtctgattccttatctatacgatttatttgctaaggaaaccaaaactggcttaccaatcatgcgtcccgttgtcttaaactacgatcaggaccctcgtgtacgcgacttgaatgacgaatacatggttggtgacgacatactagttgcccccgttgttcaaaaatctcaatttaagcggttagtttatttaccagctgggaactgggttgatttttggaacggggctgagtatgccggtaatcaggatattgtagtcgataccccactcgataaactaccattatttgtaaaacaaaacaccattttgccatggggacccgctgttagccacattagcgatgaaccgttgaaagcgatgacgtttagagtatttggtactcaagggacctaccaacactatcaagataatggacgtgactttaagtatcagtcaggtgaatggaacaattacacaattaccgttgatcacaacaaggttaatgtgcaactcactcatcacggttatcaaccagtttatcagcagatcacagttgaattgtctgatcatgttgttaaactcacttacgataatgacagtagctgttatcgagaatagtagcttaatattttaatccttaactttaataaacaccttaggataccaatcactcctaaggtgtttattatttcaattactattagatatattaacgtgctcttttcctaaataaacttgtcagtaatatcttaatgtctatccagtcgctcaaattaatccccttattcaaaacatgatcatataaaatttggtaaaaatgtattttagtaggtgtttcaagcatctcataactattatgttttctatcaattaaacccaacttaccatcgagcttaacatgataacttatatcatctagtgtcatattaacagcaatgccagccattggaacttactctgaaaacagtgatacataaaagaggaaatcaactgataacaaactgatttcctcttttaaacaattttaactattacagtagtggcttttagttaactgcatagtattgtgcttctgatcgtaatggataagaaattaattcagtcgtatccaagtgctcatggtttaaactgacactgttaatttgactattgtcataagttctatagtaataaactcccttgtccatatcacaacaagaagaatagattgtatattcgtactttccgtcagtaacttcacatagccctttttgttgttctacagaccctagtatatggaaaaactgactaacactgccactctctgtctgcatcggcaacgagtttaatttagtaaaagcggctctgacaaatctagacattgaggacaagtctccaggtaatcctagtccgcccattcctctactataactatctaaatccactttttccgaaaaactattttgaggtgtgctatttgataaggcacgatagttgttcaaattaaataattggtagtcaaaattaggattgtttgttaacacacctactggattgtcgtaaatttttagtccttctttaacactttcaataactatcgattcctgtttatcagcaaccaaccaatgtagcggtgataatggtaattgttcactaaaattaatattaaccaagtttagtttttgtatgttctttttcacttctctaacacttgaaaattgtcccaataaccaaggaattaattcaaatggtgtgatattaactttatcagcatcatattttttataatcagcataacctgcaaaatttaatcccgcaatacacaagcctttttcattcatcgcatcgtagtaaagtggatagctttctacatcagcagtaattccaattattgcataatggtgatctaagttctccaccttacgaaatactagtggatattttctaggcgtaatcgtaaccatttcattgtatgaaatttcataatcgaaatttctaccgaagtaattattataagattgataagttatggcagtacacataaatagtaatcctcctcgaaaataatatttagatttgataagccaataagcttacatctttttagtataatatcattgctgaaaaaataaagtttttttcatgaaatcatctctaaaataatttaatctattccaaacactttaagagtcaataatcaattgtaacccttatagccgatataacaatgctgttatacctacttatccttatctcgtgatttcttcaatagcctttgcaaccccatcatgttcattatcgacagttatttcatcagccacttgcttcacttcaggaatagcgttgcccatcgctactccatgtcctgcaaacttaatcatgctcaaatcattagcttcatcaccaattgccatcacattggcagcagtcaaacttaacttttcacagagtacttgcaaagcgttgcccttactaacaccattagtgttggcctcgtaataaaatggtgcacttttcgtgaaagtaacctgctttttcaacggttcaaatagtttttgctgtttaatggcagcgtctaaaacttcgggttcatcaacgtacatcgatttaatcagtttaatattccgcatctcttctggcgtccgatatgagatacccattgaaacgagattagcttcatagagtgtataatcaccaatattacggtcggccgtatacagccgatcctcagataccgcgtgaaaatgcaagcgtaacttacgtgctagggcttccaagtcaatataatcttcataactaatcggtcgttcatcaatcagttcgccactagttgtgtaggttgcagcaccgccaaaacaaacaacgtattgatcatcttgagcatcgagttccaactcctgcaacaatgctttaacacctgttaatggccgtcccgtgcagataaccactttaatcttcttttccttcgccattttaatcgcttgcttgactcgcaatgtcacctgcttttttgaattaactagtgtgccatcgatatcaatcgcaatcatcttaatattttccatcatagccatcctcattctttatcgaacacgaaatagaaaccgagcaacgccccgtttctatttcttcaataattattttaatttcagataagtattcacaacattagttacattaaagccatacttatcaagtaccaagtcaccaggtgccgaagtgccgaagcgatccacacctatcttagcaccatgatcgccagcatactgatcccagccaaatgttgatccagcttcaattgtcacccttcttgtgaccgcactcggaagcacactagcgcgatattttggtgattgttgcgcaaaccgatcaaagctcggaattgaaacgaccgcgacatcttgattatgctttgctaactgggctttggcctccaatgctaagttaacttcagaaccagtcgcaattagtaaaccatctggtatttctttttgagcagcactgaccacatagccacccttttcaacgccagcaaaggccgtatcaactgatacaggtaatgtcttcaaggcttgtcgactcaataccagaacggttggtttatcagttgttttcagtgcttgctcccacgcagctgaagtctcattaccatcagctggccgaatcacttgtacgttcggcatgcatcgtaaactagctaattgttcaatcggttcgtgggtcggcccatcctcgccgaccgcaattgaatcatgcgttaagacgtagataaccggtgcgtgttgtagtgcggacaaccggactgccgcacgtaagtaatcagtgaagacaaagaatgttcccccgaatacccgagtgccgccatgtaatacaattccgttcatcgcagccgccatgccaaattcacgtacaccaaaccagatattacgaccatcgtaggattctggctgaaagtctgatgtttccgcaatcattgttttgttcgaactcgacaaatcggctgcgccaccccataagctaggtattactttggcagcagcgttaatcgccttagcgcttgccgcccgactagccaatgcatctgttaattgatagtgcggtaaagtagatttcaagtcatcagaaaattgtccgttgaacgcttgcttaaaagactgcgcctgatctggatacttcgcctcatattcttcaaatagccgtttccattgctgctcagcacgcgcaccattttcctgaatagttacttcaaaccggtctgaaacagctgacggcacttcaaaatccgagtaattccagccatatactttttcagctgctttaatgccatccgcaccaattgggttaccatgaacagcattagtcccttgtttaggtgcgccataaccaatcaccgttttcacttcaatcaaagaaggacggtcagttgtcttttttgcaagttcgattgccgcgtcaattgcattaagatcattcccatcttcaaccaccagatgctgccagccataagcagtgaacctgtcaccaacattttcagtaaacgcttgcgacgtcttaccatctaatgaaatgccgttcgaatcgtaaagtgcaattaactttcccagcttaagatgcccagctagtgaaccagcttcgtgcgaaattccttccattaagtcgccatcaccgacaattgtataagtgtaatgatcaacaattggaaaattaggtcggttatattgggcagctagatgtgcctccaccattgccattccaacggccataccgaagccttgtcccaacggaccagtagttacttcaacgccatcggtatgtccatactctggatgccccggagtccgactgtcccactgccgaaaatgcttgagatcatcaatcgaaacatcatacccggctaaatgtaacaggctgtataacatagctgaaccatgtccagctgaaagaatgaaacgatcacgattaacccaattcatgtgtgtttgtgggttgacttttagatgttttgtccataacacataggccattggtgcggctcccatcggtaaccctggatgtccggaatttgctttttgaattgcttcgatacttaacgtccgaatagtattaacacccagctcgtcaactttatcaaacattatacttacctcctaagctgctattatgattacttttgcgttgcttgaaatgctttccaatccgaagcaaaactggccaaacctttgtccgttaatggatgagaccataacttaccgaaaactgcggctggaattgtggcaatatcagcgccagccaacgcagcttcttgaacatgttgtggcccccgaacactggcagcgataatttccgtcttgaatccataagtatccaaaacttgacgtaaatccttaactagctgaattccattgccaccaatatcatcaagacgtcctaagaatggtgaaatgtaagtagcaccggcctttgccgctaataagccttgcgaaactgagaatacaagggtcacatttgttttaatgccctcaccacttaatactttgaccgccttaagtccttcttcagtcatcggaatcttcaccacaatatttgaagcccacttaacttcattgcgagcctgggcaatcatctcttcggccttggttgccgttacctcagcggatactggacctgatacaatctgcgtaatttctttgataacggtttcaaaatcacgaccttcacgtgacaccaacgttggatttgttgttaccccatctactaaaccaagttccgcgaaatgtttaatatcttcagtattcgcagtatctaagaaaaatttcattatgttgtgctcctatttattaagttttttaccagtagtttcttcatagtcagtgaccatctgtgaccaggctttattgatattagcgtcaagtacaaataagccacttcgaccaacaatgtaaatatccggatcggcttcatcgatcattttaaagtgtgctcggttagatgagccatccatttcaattacataatgatagcctgtcttctcacgcatcgctctcagggccacgatcttttgcaatgctgtttctaggaaccgttgtccggcaaatcctggatcaaccgtcatgatggtcactttatctaataacgcaatatatggctcaatgaccgaaattggtgtttcaggatttagtacaacgccagcctttaatccggcatcatgaatctgatcaatcaatctgaaagctaagccgttaatgacctcagcaggcatgcagatgaactcacatttgatatcaattaattgttgtacccagaacggcgcatccgttaccatcaaatgtgcagacattggtaactgactcacttttctaacttcctgaataaaccatggtgaaagtgtaatgtttggaacaaagtgtccatccataatatcaatatgatacgagtctacatgttgatctaaaaattccagttgatccttaaacttgtctaaatccatcgtcatcagcgacggtgaaatttgtacattgtccatgtgctattccctcctaagaaatttgaatatcatctaaatcaatgtctttctcatcatcaatactgtcttccttaacctcatcttcaacgggaacatcttttttgatgaaggcataaacaactccggttacgacaacattgattgcaattgctgccaagcctgccaaaggatgtgacatcgttggaagcatcagaaaaccgccaaacgggacggtcgcgtccgcaccaagtaccatggttgtggccccaccacacataccacctaatgcagctgctaaaataccacgaaagatgtcgttcataactatcggaattgatccttcaacgatgttaacaacacccattggtactgctgacttcaaagtttcaacttcagccttcgtataaatgtttttccgcaataatttggcaatgaagaatgctaatccaaaaccaataggggttgcagtatttacaagttgcaaggccgttactggtccgttaattccttgtgcttgaagtgttaagacaaatgcaaagaccgttttattaattggaccgccgaaatcaacaatgcttagaacaccaataacagcacctaagaggagatttgaagcggaacccatccctttgagaaaactagttaaccatccagtgaaccatgccaccggggttccaaatacatagaccatcaatagcgcactggctatcgaagcaagaaaaggaacgatcaacgttggcatcagtccttttgcccaactcggtactttgacatatgttaataccagccatgcaaagtatccggcaacatagccaccgataataccaccaataaacccagcactaattgcaatcgctgctagcccagtaactaatcctggtgcaattcctggtttaccagcaattgagaacgcaatccccgttgaaataatcatcggtagcattccaagccctttgccaccaattgtggccattgcttggaaaaagttaaatttaccaatcactaatgcgtcttgtgatttaccaccaaatgccatcccaatagctataataaaaccagcaccgcaaacaataggaatcatgtatgaaatagctgtcaacaaatgttccttaaatcttgctttaccaattaattctttcactactttcatctcctcaatattcacatcaagatagatcacatattatgacttagctgaaacaacctcatgtagttttgcaactagcttgtttggtgatttaatagcaacttcggtaggtactttgacaattttcttaccttcaaaccgttcttcgccagagattttgacatccaccgccaacaagacgatatcagcatttttaacttcttcttcagttagctcattctcaatgccaatcgtaccttgcgtctcaattttgacttcatctccaagttttttggcagcgtttttgattttttcttgtgcaatataagtatgtgcaatcccgacagtacaagcacttacaccaacaattttcatttttaatttcctcctaattgttaaaagcttctttgacatccttagcactatcagcagtcagcaatgcttcgattacggcatcacgtccaagcttacgagcaaaaagtgataataacttcaaatgctcctttgctccctcagtatcactaccaactgcaaataatatgattactttcacaccatggtcatcaatggtttcccaatcaatctcatgatctaaaatgccaatcgccacaccaattttcgagacactgtcactcttaccatgtggaatagcaatatagtttccaattcctgttgatccttctttttcccgttgatagacatcgtgaatataccccgctgtgtcatttaagtaaccagctttgcttaatgtagctgctaattctcgcagcgcatcatctttattggttgcagtcatatgcgttaataccgtctgactatcaataactgaagtaactgttgtttcagccatatacttttcctcccttaaaaatctaatattttgataatttgagctttggcattctgttgaaatgcatgttgcgaatcgccagaaattgccaacttcaacgttcgggtaatggtatccgcatctagtttagaaatatcttgttgaatacaacaaaagataaagttttgcgcatcatcatgttcatcccactgttgaattggtttgcacgtgtgcactaaaacaactgtatttcgtttgattgaacgaccttgtgcatgcggggccgccaatagttggtcaatcattgtactccccgccttttctctttgttgccataatttaatggcctgccttggcgattcaatcacgccgttctcttgtaataaggtagctacttggtcaaacagtgcttttttcgtcgttaccaccgaatcccaaagcacgaatttcataatctttgatttcattgcaaatgtttgacctcctcattaagcttttttcggtcttccatattaagcattgcactaacaacgactaccggaaccgacactgcatgtaaaggtcgaaccgttgagatgactaactgaatctgtggatatcttcgcaaggcttcatccagggaagccgtcgagataacatccacaatattaaggttcgaaaaattagcaatgatctttgatttcaataattccgatgtaccaatgcccgtcgtgcacataattaaagtgtcgatatgcttcttatgtttctcaagctcacttgcaaaatacagtgttaaaaagccaatttcattatcatcaacttcagacaaattatatttactagctagttgtttgattgcacgtttaaccgcctgaaacattgcactatattcaatttttatttgatctaacaaattattattgatattaatatgattatctaaacgatttagcattggtcgaatatgttcactcaaccgatttaccaagtcagaattatggaaatgcttatttgttagtgattcaacagccgaaatcaaatcattagttacaacttgtaccttactatgctcagcaactgtattcggaacaaagccatctattcgtgaagatactaaatattgatataagtagtagccttcgatcttagggagtttgacactaatgtaattttcagtattctttataacttgttcgcttactccaaaaagccgatcgtccaacgatgatactttcagatactcatccagagcatgatcattggttttatcaactgccatttttgtattgcgcacacgatcaagcaatatatacatatgtgaaaacagatttagattatatggatacgggatactactctcaatattcgtttcaatgtatctaatttgctcaaatacaaatcgaacgtcatatttacgaggaaaattatcatcatgcaaaatctggttcaaatccacaatacctgtatcattaatcaagctttgaatcgcatcacgaatatttaactctgagccaataacactaagatatccactgttcttcactaattttaagctgtaccgttgtagtattttggcaatgcttttttcgtcggaaatttgtgatgaaacgcttaaaaaatattcttcaaacaacgtctctgcttgcacacgccttggggccaccaacagtagttgcttcataattctatttcttctttcaaccggagaaatagtggctaaacgacgtatatcgacattttgctgattactgtcaagatattgctgataatctagtttataacctcgtcctctttctgaaataattaacggtcgctcatcatattgactatttatttgcgaaatcagacgataaattgtcttgtcggaagaatgaagctcatcagccagttgcttagcagtcacaaaatcctttttattaaccaataagtagatcaaactgcgttccctttttgtgctcattgattatctccccccctttcgacatattaataatacagcgcttacatttatttgaatatctatctccgtccgttacaacagacattattttatacttaactttaatattaattaacgcaaaacagaaaccagacacttggcctcgtttctgtttcagtaattattgttttaagtagcctttcacaacacctgcacccttaacgatataatctcataactgcattacaaaacatttagctatcctttttactgagacaaacccattataatttgcatattttttggtagcatcagctttaaactgacactttccatgtaattccactattatattcgtgtgtgcactaattaatatgtcattttagttcattgattatttaagctatcttctataattcattaaaaaagagcaccaagataaatatctcgatgctctagttaaggaggttataattttaataatctgtcattcaactacaattggtttaatcagctaaatctggatcattaggattagaagcaatcataactttaagttccttaccagccatcattgcatcaaaagcgtcacgccaatgttcaagatcaaagaccttcgtaatcatcgcatcctgattaatagcacccttactttcaagatgtaaggcaattggccaatcataaggattttgtgaacgagaaccccgataggtaatttcatgctgaataattgagcgttcatccaattcattcattggctttgcaaaaagaccaacttgttggaaagttccacctttacgaatcaatggtaaggcagcattaacagctggcgttgcacccgaacagtcatatactttggtaacaccaacaccatctgtcgcatccattacgaccttggccaagtcttctttttgagtatctacaatgatgtcggcacccaattctttagcaatttgtaaacgatcagcatccttagtaatcccagaaacaatgacaaaagcaccaatttctttggcaatttgtaatgagagtaaccccattggtcctggtcccataattaataaagtatcatgtaaagtaaatggcgtcttttgatacatagcgtgaacacatgatgctaaaggttctgacattgcagccattttgtaggaaacattatccggcaaaatgtgagcgctttcttcgcgagtcaaaacatagttggccattgaaccattggctttagtcccaattccttcacggttaggacataagttatattccttatcttgacaatagacacaagtctcatcagttgcaaatgtcgtttcactagtaacgcgatcaccaggttttaaggtggtaacatcaggacctactttaacaactttacctgagaattcatggcctaaaacaagtggtgttactgcattggcatactggcctttaaatgtatggatatccgtcccacaaattccagtataagcaaccttcaataatactttatccccagttacttcaggaattggaatttgtttcaattccatattgtcatagccagattccgtcttaacaacggcctccatagttttagcaccctttaattcatcggtttcagttgtttttacagtatccataattcattttcctttctacggataatcttttaattaaataacggctgtactaactgtgataatttcaaaattaaccagttcaagacattaccacccgtatccaagttggtaacttctgacgcacccttaggaaaggcaacaatcccgtgcatcattgaagttaacgttggtccaaagtccgttgccatcagcaatgcgaataccattacgatagtagcagaaagtacggagtggacgatatttcctttacgactaggaacaatcaaagcagcaaagaatggaatcgtcgctaaatcaccgaatggcaatacccggttaccaggtaaaataatggctaagaataacgtaattggtaccattagtagtccagttgccaaagtggctggtgacccagttgaaagagcagcatccatccctaagtaaatcttccggtttccgtacttctcctgaagtaacttttgggcaccttcttgaattggaattaacccttccattaagatcttaaccatacgtggcattaagaacatcacaccacccatggacattccaagcttcaaaatgttcggtacgctgtaaccacctaaggcagctagtaacatcccaatgacaatccccatgaccatgggttcaccaaagaccccaaaccgtttttgaattgtttgtggatccacatcccattttctgatcccaggaattttgctgacaacccatccaattggaataccaagtaagccatacgctgcagcagaaccagttggaaagctaatcccatccaagccataaaactcagcgacttttggcgcagttttatcagcaataattaagacagcgatttcatagataatcccacaaagaattgcaaaccaccagtttttcgtcaccacataagccgtagctgcggccgcaatcatgtgccagtaattccaaatatcgatatcaagtgttttagtaagatttaacaaaattaaaccaacgttaacgactaaaataattggaatcatgatagctgagattggttgtgcccatgtcccagcagaaacggcaggccatccggcatcaataatcgtcaaatgaaacccaaatcgcttgaccatcgcctgcgcagcaggaccaacactagttgtcaacaaattaatgaccaggttaatcccaatcataccgataccaacagtaatcccagatgtgagtgccttacccggtttaaccctaaagattaacccaacaataaagataataatgggaagcataacgctggggccgacattaatgatgctttgtacaacatcagataatactttcataatgcatcctcctgcttaaaaccctagctcttaattattgtgcttgaatttcgcgtgctttagtcaagatttcatcttgcaatttatcaacaccaagaccagttaaaaagcccattgctttaatcgctggaatcttatattcagttggtagtacagttgttgaaatcaacatatccgcgtcatcctgcttagaagcagcttcagcaatcttaatttgaatcaaattagcatcaatattattttcggcaaacaaatcttcaacctttttcataacaaccgttgaagtggcaattccggcaccgcaagctactaatacatttaattttttcatgataatctctcctatatatatcttctgtgttatttaagtacttttatctactcaacaattgatgaatttgattagcattatcggcattttccaatgaatttactgagagcgtaaaatatcttgtgtaaatgcataaaagatttctgaattgtatagaaatagggaatgccttcccttatgatatttagtaaccacagaaaacatcacaggaggcgttccccatgaatgaacttaccacagaaattatcgctgcactagcccaaaagcaagatttggacgaaatttttcgccaccacctcgaaattgcgattaaccagctgcttcaaaccgaattggcagagtttttgggttacgaacgctactcatacgctgggactaacactggtaataaccgcaacggcagttatgagcgctcgtttgatacgaagtacggccaacttaacttaaccattcctcgagatcgcaatggccggtttgaaaatcataccttgccagcctacggtcggcacagtgataatttagaaacaacggtcattcagttgtataccaagggaattaccactgctgaaattgccgaactcattgagaaaatgtacggtgctcactactccaaagccacggtttccaacatgactaaagccgtcaatgaacaggttcaagctttccagcaacgtcgactggcttcacaatatgcggccatcttcttagatgccacttacttgccgttaaagcgggataccgttcaaaaagaagccgttcatattgcgattggcattcgtccagatggtacgaaagaagtgctgaactaccaagtggcgccaacggaatcgactggaatctggactgaactgctggcaaccttgatcaagcagggcgttaaagatgtgctgttgtttgtggccgatgggttagttggtttggatgaaggcttgaatcggcatttccctaaagccaaacgacaacgttgcctggttcatgttgggcggaatctgatgaacaaagttcgcgtaaaagaccgcaaggccgtgatcagtgactttaaacaagttcatcgggccgccaaccgtgaagcagccgaactgaaactgaatgagttcgccaacaactggcatcagacctatcccaaattaatcaaagatctgcttaaaatgccgaatttactcactttcatggactttccaccagctatccggcaatcactatactccactaacctgattgagaactttaataagcatctcaagcgcaccacccaccacaaagaacaatttccaacggaagattcactggatcgcttcctagtttctcagtttaatgtttataacgagaagtctcttaagcggatccaccgagggttcaaaggactccaggacaccttggaggcatcatttatttaagttagatacatattatatgtacgaaggcatttcatttacacaagattcttgacgctaccaatttactaattcatcatcttgaataatactcattaacgcttgcaacatgtccaactgggcatgtggtttatttagaccaagtacaaaaactaacttcgcagcaaccttttgttctgggtcatccatccgactaaatgcgattggatcatcattaacaaccacggcaacaaattctttgttgatcgtatctgcgtcagtatgtgggatagccacaccccgatgttctaattgcaaaccagttggaaaggttgcttctcgcttgataattttcggtaaaaattgatcagtcacaaacccattttcctgcgccttcgcattaatcgctgtaaataattccttcgacgttttaaaagaggtgtgtagaaaaataagttgatctcttaaataatcacttacttcgacaaggttctcactcaaaataagtcgctcccttcatgttttataataatgtaatcgctttcaacagttaaaattgtatcattttgcaattcttttgcaatacttttctttaaaaaagtttttaatcgttgtttgcaaagatgatttggcaaacgggaatgtacatataaagccaagttaaaattatcacaaagttatttgcattaggactttaagcgcttacacaataagcattctgataacgatttcaatcactttataaaattagtttgcaaacaaatgccaaacatgtgatatgattacaagcgaaaattatttttctttttttacaaggaggtcagttcatatggaagttatgcaacgccaaaaatatattctggatcaattaaatcaacgcggtacgataaaaatcgctgaaattagtaaggaaattaatgtttcacgcgaaactatccgtaaagatatctataatcttgacaaacaaggactgatacaggccattcgtggtggcgccaccacaccgcaaagtgtcaacgaaaccaagtatggtaagcgtcaacatgaagcagtttccgaaaaaaatgaaattgctaccaatgctcttcgactcattcacgatggcgagtcgctcttccttgactatggcacaactgctttccaagttgccgaagaaatcaaacatagtcatttaactaatttaactgttattactaactctacttttgtccttaactcgctacaatttgttaaagacatccaaattgtacttttaggtggaacaatgcgtactagtgaaggctccttatctggtccaattacactagataatatcaacaatatctatgccgatattgggttctttggttgtggtggcgtcaatctgcaagccggtattaccaaccactatatagaagaagttgaagtttctaaaaagatgatgtcacactgtcgtatgaaggtcatcttagctgaccacactaaattcgaaaaaaatgcactttataagacaacagatgtgaatgatattgatgttatcattaccgatgaacaactagacaatcatctagccaaacaaattcgattggccgatatctcattgatcagcggtaaataaaaattggttggggccggtttctgaccactttttgcttttatacacaaaattttagaattaatttgccaatttcgtcttgactttatgtttgaaaccgctatcataataaccgtaatgataaacaaaacaaaagtttgcaaaggagttgcaaaataatgagtgaagcaattaaatccaaaacagttgattactcttctgatgaatatctaaaacgcgttgatgaatattggcgtgctgctaactacatctcagttggtcaactctatctactaaacaacccgttacttcgggaaccactaaaggcgaccgacgtgaaagttcatccaatcggccattggggcacgattgctggtcaaaacttcatttatgcccatttaaaccgggcaatcaataagtatggcttgaacatgttctacattgaaggtcctggtcatggtggccaagtaatggtttctaactcctacttagatggcacctatacggaaacgtatcctaaaattacccaagacaaagctgggatgaagcgcttattcaagcaattttcattcccaggcggggttgcttcccatgccgatcctaagacgcctggttcgattcatgaaggtggcgaacttggctactcaatcttgcatggtgctggtgcggtactagataatccaggtttaattgctgctaccgttgttggtgatggtgagtctgaaactggcccattggcaacttcttggcaagttaacaagttcctcaacccgattacagacgggacagtcttaccaatcttgaacttaaacggcttcaagatttctaacccaacagttctttcacgtgaatcacatgaagaacttgaagactactttaaaggtctaggctgggatccacactttgttgaaggtacagaccctgccaagatgcacaaaatcatggctgaagaattggataaagtcattgaagaaatccacgcaattcgtaagaacgccaaggataacaatgatgaatctcgtcctaagtggccaatgattgttttccgggcacctaagggctggactggtcctaagagttgggacggcgaaccaattgaaggttcattccgggctcaccaaattccaattcctgtcgatcgcaatcacatggaacacgccgacaaattagttgactggctcaaatcatacaaaccagaagaattatttgatgaaaatggtactttaaaaccagaaattgccgcaatcatccctgaaggccaagctcgtatggctgctaaccccgtcactaacggtggtaagttaactaaagacttaattacaccaaatatcgatgattatgctttggacaacaaggatcacggtaaagaagacggttcagatatgactgaacttggtaagtatatccgtgatttgattgagttgaacaaagacaacaagaacttccgtggctgggggcctgacgaaaccttatctaacaaactaggcgctgcttttgaagataccaagcgtcagtggatggaaccaatccacgaacctaatgatgctttattagcacctcaaggccggattattgactccatgttgtcagaacacatggatgaaggaatgttggaagcttacaatttaaccggacgttacggtttctttgcaagttatgaatcattcctgcgcgttgtggattcaatgttaacccagcatttcaagtggttacggaattctcacgaagaaaccccttggcgggctgatgtgccttcactgaatgtgattgcatcatcaacggccttccaacaagatcacaatggttactctcaccaagatccaggtatcatttcacacttggctgaaaagaagaccgaatatgttcgcgcctatcttccaggtgatgccaacaccttgattgcaacctttgataaggctatccaaagcaaacaattgattaatttaatcattgccagcaagcaccctcgtccacaatggttcacaatggacgaagctaagcgcttagttcgtgatggccttggtgttgttgattgggcaagtactgaccatggtgaagaacccgacgttgtcttcgcaactgccggctctgaaccaacgactgaaagcttagctgccgtatcaatcttgcatgcacgcttccctgaaatgaagattcgcttcattaacgttgttgatcttctgaagctgaagaaagacgaccctcgtggtttatcagatgctgaatttgatgctttcttcactaaggacaaaccagttatctttgcttatcatgcatacgacgacttagtaaagaccatcttcttcgatcgccataaccataatttacacgttcatggttaccgcgaagaaggcgacattaccacgccattcgacatgcgtgttcgcaacgaactcgatcgtttccacttagtcaaagctgccttattagcaacgccagcttatgccgaaaagggtgctcatgtcatccaagagatgaacagcattttagacaagcatcatgactatatccgtgctgaaggtaccgatattccagaagttgaaaactggaaatggactgcattgaagtaatcaattaacaaattctatattttcatgtaaagaccaatcctcaaaatactgagggttggtctttatatgtacaaaaggcctttattagtaacatccattaagttatgtaggacttgcagccgtaaaaaaatagcactgaatattaattcaaaaatatacagaagcaaataggactaaacatagtaacttcatttaatttataatcctatttgcttctgtaaagcttaattatattatttcattttttgaactggtaatcacttaacccaaggaacaaccacattgtgccatgtccgtttatcaatcatcgttcgtggcaagctgtgagttatatccgtctgttcattgatcagtccaatgttcaaagaaaaagtagtaacgttacgattgtctagataacgttgcactcttggtgtctctgatccgtatggataagcaaaaaaggcggcttcttttcccaaataatggaccattagtttttgagactcacgataatcttgtttaaattcattgtatttatcagcagtaattacagccgattgattatgcaaaagatagtgtaagttattagtgtgaagaccaaccgtaattagcctgttattggccatgtgcttgatctgcgaccacgatactaatttagtcccactatgatatgatcctgtaattccagttactgtaaaaacagtgcatggaatcttatatgctttcaaaattggcaacccattatcatgaacagtttgatcaaaatcatcaaaggtcaacacagcatattgatgttttaatggtctgcctttttttaccatctccaacatttgttgcatggaaataaaacgcacaccacgctttttcaaataatccaactgtttttgaaacgtattcacatctatagcgtactcatgaatttgagaattattagtgagcttcctaataacattattactcaaattatctttaacaattcgatgataacaaagcaccatgataccatttttacgttgctctgctttttttaacgttccctcacttacatccttcttatcttgttcttgatctactgatttttgataagtgttttttattactaaaacacttaaaaccaaaaatacgacaacaaataatcgatgccataactttgccatactcatcccctcccatttttaacccatgctaaccgaattaatactagtccaattattatcatgctggccaatcccatggtctttacagcaccaagaaacaaatccaggtcacaattgaataggataaacaaatgcactatggtttcagtcgacgtacccatcaaaaacaatacaaatagtattatcaacaatacttgtactaaatcaacaattgaaattaaactaaacttgaaaatagatttgagtgttttaaccatcgccatgcactcctccacgatccgaatcaccccatgctgcatattgagctcgatcaaacagatgataaaaggcaataaaagtaacgactaagttgtaagaccaatagagatagaaatatataggtagtaacaaaaatcttctcactgaactattgatcagtaatcgtctgaagttcagaattctagcagccaagtaaaacagcaacgttagtccaaaatacagaataataatatccaatctcagcccaagatgatggtcaaaaacatattggaaaacgaaccggataagtgagaacgacaacaaaaatagccatccgtagctgaacattatatccaaagtcaacaaccactcaccccaagacatctcatgtaaatatttaattcgattgtaaaagacttcagctccaccgcgagcccaacgtgtccgttgtttaaggaatcctaagatcgattcaggaacaaaaatatggcataacgctcgtggttcataaccacaggcccacttttgacgatataggcgccatgtaatatcaatatcttccgtcatagctgccggattccaacctgctacatcaactaatgctttccttctaaaaagtatcagtacccctgatacagttaagatacgttgcgttaataaaaactcagctcgtttgataaaatcaatattcataaaatattctaagtattgtaattttcctaatgctgtagtcgtattctttaccaaagggcgaccagtaacggcgccacaatcctgattgttttctaaaaattgaaccattaattgtaagcactgctgatcaaaaatagcatctgcatcaacacacaaaatataatcggccctactagtcgataatgctttattcaactcctctgctttaccctgatttctatctgaaacaataattttgatattcgaataatcattagctagttgtctcataatccttagtgtgtcatcactactatgatcatcaattaaaattaacgaaaaattttcataatccaaactctctaaagactgaaccgcagtttccaaaacatcagcttcgttataacaggacataaaaatatccacggttggttcctgttcatgaacagaaacactctcatttttattagtttgatattttatcaagagctcataaaacattgttccaataatccaaaccaatgacataataattggatagaacaactcaaactttcctagcaatatactcccacctttatttcatgttccaaattaaacctacaatacagctcaattttaacctcgagtgacttacaaaaggtctattcaatatctcttaaaaatgcaataatcactccacttctactgacaactacggcaagactaaataaatatagcgacaaaataaaacagtgccgtgatctacaaactcagatcagctagcattgtttttagatgtaactatcgttagaacaaacactatcgattaagatagcttgcttttaattatacaaatactgtcaaaaaaagcattaaaaatacactttaacttttcaaattattgacaagcacgacacctagtccattcatctaacagtcctaatctttaaattaagtatcgttttagactagtaaagtaatcgatttcaatattattgctttacatgttactcttgagctagttattttatcgttcacatataaaaagataggtgggtctattatgtatcataaatttctggaaataacccaaaatgggctaattatctcgtgtcaggcgttacctaatgaaccactgcatagttcatttattatgtcacgaatggcccttgccgctaaggaagctggggccgcgggtattcgcgctaattccgttgttgatattcaggccattcaagacgaagttgatctaccgctcattggtttaagcaaagtcgactatcccgactcacctgtttacatcacgccaacaatcaaagagatgcgagccgttgctgctacgggctgtgccgtagttgcctgcgatgtcacgggccagccgcgtcctaacggtgaaaaattggcggagattgtggccaccatgcaaacagaattccctgataccctcttgatggctgatactgataccatcgagaacgtcaaagtagcggataagttagggtttgatattattgggaccacgatgcacggctacataccagccacgactggtgccaacattgctgataatgactttgcctacttaaaggaagtcctccaagccacatcacgccctgttatcgctgaaggtaaggtggatacgcccgagaagatgaaacgttgccttgacttagggtgccacgcggtcgttgtcgggggcgccatcacccggccactcgaaatcgcacaacgcttcattagcgccttataattttagacatggcaaattacaagtttaatccgaacaagcccggaatctttcaatggcagtctgttgatgatgtatttttaatggtcgttgattaattagttcaagtgctgctaggatctcatcagtcgttacttggctaaaattggtctttttcgggaagaaccagcgtaaccgtctattaaaatattcattggaacctcgctcccatggtgaatatggatggcaaaaataaactttgatctgataatcctgttctaaggcctgataattggcaaactctttaccatgatcaacagtaatggattttacttggggaccgaaggcccccataaacttgccaaaggcggtgtttagagccttagccgttctattaggggctttgatggcccatagaagtcgggtcttacgttctacgaatgtaaccagacatgatcgtgactcacttcgactagaaagcaccgtatctacttcccaatgaccaaaagctaaccgttgattaacagttgttggccgttgttcgatggaagtcccacttgtaaatttcccacgattttcgctcactcggtgctggcggacattccgattgggtagatcagtcaatttgaaggggagccagccacgattaagccaattataaattgacgcagtgctcaagttataagcggccgcaatggtttctggtgaccaggttaatcgtaagtgattggtaattaaagtcgctaatgctgccgtcagcatcgaacgacgaccgcaattccgccttttgcgatctgcatcttgctgagctaattctggatcataaggtttaactcggtccaactcatagctaatcgtagctttggcgacgcctaaggcgtcagccattacttggtaagatttattcccctcattgaccagttgtgctagtgcgccacgttgaaaacgtgataaagtagatgtacccaaagtaatcactccctatattggttggaattagctgctaccattgtaagtgattgctttgggatttttaatttctgttcggattaattatagaatttgccacattaaaaataaaagccagtcgtaagcaaaataacttacggctgacttttcatttgttactgaaccatcgttaatgatggtcgatttgtcctgacgtatattcacaatagcgcaaatgtctcatccagatactatcccgcttgctctcgaatggaacctaccaaatcatccgtggctggagcgttcgcaagcaatgcgcgaacatcatcaaggttcaccttaacattccagactaaaacaccaactaacttaccggcatctatgaaatagacaagcgttccatgcgttcgccgatcaaaaatcaattgcaatttaggatcaatattaccgattgcttgccaggaaatatcaaaaatcatggaatagaagtatggggtatgttgatagctcatgtgagcacctgccatattacggccaactaattcaccagaaagtcgggcatggtccacgtgctcaatccgttgccgacccaagatgtgatctggataagaggcaatatctccagcagaccagatggctgggtcactagtattgagatactcattaactttcacaccaccatcagctaaatccaaactactatcttcagccaaactaatccgcggcgtaacacctaacccaacaataatcgtatcggctgcgatcaccgtaccgtcctttgtcaatagagtcaaatgatcaccttggcgttgatatgattggacaaactgaccactcatcagtgtgacaccattacgtttgaacgttgcttcatactcagcccgaatggactcagaaaatttaccctcgcccagcgctttttctgggaaaatcatcgtaactttagtcccattttgagtcagtgacgatgcgagctctgtaccaacatatccaccaccaatgatcacaactcgcttgttcggaccactaaatttacgtaacttgcgataatctgaccactgtctaaagactagcacatgtggatcagcaggtccctggatttgtcgaggttctccgccagttgccagcaatagctgttcatacttgatttgctcactatcagtcactgtaatgaccttatcttgccgattaatagccgtaaccgttgtcttgaacttaaaagtcacattaggataattttcagcaccaatccgaatgttctcttcagtaaactcatcatctagccatagctttttactcagtgctggccgttcatacggaacatccgcctcttgcgaaataactaagattgcgccctctggatcttcctgtcgaattcccttgatggcatagccagcaaccattccgccaccaacaatgacgtatcgatagttgtttgtctgatccaaatcactcatttaatcgcctccataactttactttttctaggaccattgtaatataaaaacgccatgattcgaaaaatgacgctcaagattattaatcattgattccttttatcagaacaataattttatttgcataccgtcaaacatctatcaaacaccgctgtgatcaaatttagaactactgctaacacaacataaaataatattatttttaattactcaacccaactttcaaggtaagcattctaaggaatgttttatcatatcagttgttgctatggccgtttttttgatcttgtactaaactattgatcaattcgctatgctataataattgcgaatattcactttaactatccgtcgtttacaatcatcacccgttcaaaagtatcagtatattcggcatcataatgatgagttggtccttttaatattcacctgttaattttaaaattcgataagggagtgtggcctatgcgtctatggcatgaacaattaatccatcaattaccacgacaacaattactaggtcaacaccgtgagcttgccgcattgagaggcaatggttggggtaaaaatcatgcaaccgttaattatgttttcaaatattccccttacaagttgtatcaatttcatgtattagtgatggatgaaatgcaacttcgcggctatcatcctaataaaatatggtatgatccaaattatcgtgggcagttttgcccgccttatgatcacctcactcctattgcattaacaacaccaatctatccagaacacaacgccagctacttagcagaatgtgtccgcaatttagctgctaagggaattatcatgcccaccacatagccgctcttttattttgctgggtaccaactcaaccatcgatacccaaattgtttttccgcagtcataataaggccagttaatattaaaaaaggttgaactagacttgaagtgcaatagaaaagttagacttatttgtttaacgattgtagcgcgtttcataccgtgttcaacctctttttgtagcatccatcgatattatctaagcctcattctatcaaaaacgtgtcgtttttctaacgccttaatgaagtaaaaaatagcaatcacctgtaatggtatctgaatgatgacgcgtgccaatcttcccaacaataacactttaaaattagtgccaaatagtactgaaattagccatgagtccatcatcaaactaacaaaaatcattacaagtatttgcgtcatcacaacggataaccaattgactgatttacgatataaaacaaaccgtcaataaatccccctaaaaatgcagttaacaaaaaggcaatctgaaacgcgccggaaccaaaaatagtaaagcttaatatatcggagatcatctccaagagaccaccccaaatgggaccatatagataaccaatacaagccatagacaaaaagccaaaagataattgaaaatacgctggtccgatagcaattttgtataaaataacgtctaaggccaataagaaagccgatgtagtcagcactaataaattcatttttggcaactgaaaaacatttttcgcaataagtttagacataggccaatcctctttttttgattttaatcataccctcattcttaataaaagtaaatattacttttattcgattgaaggtagtttaaaattgtcgctcttgatttagttccttgaactcaatgatattactcatactaaaagccactaacaggtcaactagtacacccatcagtgactcattgtaaaattaatttttatccatgtaacttatcttgtaatttatcacccaagttatcaattcccttagcagtaagtacggtcccaccaataagaacaccacttacgattaaggttgcagctaaacaaaactttaaaatgcttttaatcatcgcaatcatctccttactaatccatccgtgtcagaacaaatgaggttatcgcaacaacaatcacaccaccaataattgaaggaacaattgccattccggctaattgtggtccccatgatcccaaaagagcttccccaattgcagatccaaccaatccggcaataatattactaatccaccccatcgatttacctttattagtaatagcacctgcaattgcaccaataatagcaccaatgatcaaaacccataaccaatgcataaaatccctcctagacttattaaaccgcttaaatacaataatagaattacacgaatatttaagccgattcataaatgattacttcttataattatcattttacaattatcgataatgatagacaaatataacacattatttaataaatgggtcgctactatttctcatgtgacgattccgggtggcctagaaaatatcaaacagcttgatagctgattaaaattaaactacgccacatgaacgattaacttaactgtgcataatgattgaagtcactctgttaaggtgttagcgtttaaattgtgcaagagctttcttgtaatttacgtgaaaagggcgattaaaatgacggaaaaattaacgacggaaaccggccaaccatgggctaacaatgaacattcccaaacggcaggagctcgtggtcccgtattaatgcaagactataatcttttggaaaaactagcccattttgatcgtgaacgaattccagaacgggtcgttcatgctaagggggccggagcaaaaggtttttttgaacttgaaaacgacatgggggaatatactaaggcagacttatttaatggtgtcggtaagaaaactcccgtaatcttaaggttctcacaagttgccggtgaaaaaggttatcctgacaccgttcgagacgtgcgcggtttttccttaaaattttatactcagcaaggcaattatgatctcgttggaaacaacacaccggtcttttttgtaaacgaccctttaaaatttcctgacttcatccattcacaaaaacgggatcctaaaacgaaccgtcgtacgcaaaatatgcaatgggatttttgggctcattctccagaatcattgcaccaggtcacttatttaatgggcgaccgaggacttcctgcgtcctatcgaaccatgaatggttacggttcccatacttttaaatgggttaatcagaatggcgaacagttttgggttaagtatcacttcatctcagaccaaggcgttaaaaatatgactgctcaagcagctgaaaaagcaatgagccaagatttagattatttacaagatgacttatatgatgcaattcaagaaaaaaattacccatcatggacgatgtatgtccaaatcttgccatatgaggaaggtctaaactataaatgggacatttttgatgtcactaaagtcatctcccacaaagactatccactaattaaagtcggcaaactaactttaaatgagaatcccactaataactttaccgatattgaagaggcggccatgtcgccagcaaattttgttcctggtatcgaaccatctcccgacaaattactacaaggtcgcctattctcctataaagatgcacagcgatatcggttaggtgccaactttgaagatttacccgtgaacaagccggttgttccagttcataattatgaacgtgatggttacatgaaaattaataatcaaggtgctgaggtcaactacgagcctaatgcactgcatgggccagaagaggtgccggatgccgcactttcacctgattctgttcgtggtgaaacacgcgcacagccttatcgctatcaagttgattacacaactcaagcaggcgacctatatcgcttaatgtcagaacccgagcaagaacgcttaattaatactatcaaagatgcgttaggccaagttactttgcctggtgtcaaagaactcgaaatcaagcaattttatgaggccgacaaaaactacggtacacgcgtggctaatgctctgggaatgaatattgctgatattatcagtgattaatattttgaccggatgttatccatcgcgatattatttttgttataaagaatgatgataccgtctcatggttattaactaaagagcgacaggttagactcatatcgtgtaagtctagcctgtcgctctttaattaacaaaaaatcttagatatagcttactactcgaccatccttttattaataatgtgatcccctgtattaccatctagacgactcaacaatgcattgaactttagtcgccgaactggtcgtggaataaattggcgaatatcatcttcattaaagccaacttgaattttactatcactaatgatgataggccgacgtaacaacttcggatgatcacacaacaatttaagtgcctcattcaatggcatttcgggtaacttaggcgcaatttcaggatagtctttagatcgagctgagataatatcgtctacaccatgttcggttaaactcaaaatacgttttagatcttgcaccgtgggcgaatcaacactaaaatttttctccttgaactcaatcccatgtgcttccaaccattgccgtgcaactctagaagaatgacagcttgattgtgtatataacctaatcattcctaatctgcccctctctcgttaaaattcatcacagcgtattgatcgacattaacttctgcctgtcacaacatcctttaaactaaacgcattcgttactgtcatgaccaatccaataccccgtgaacacatctttattataggctctgaacaagggacataccgaccgttttaagacgaataatctgaggataatcgttttaagtacacttttaaacggtttaggaaagaacgaacccagtacacgtaatgctaacaaatatcactgcaatttctaatcgaataacgctgaattttcatcgcgtagcacataaaaagtcgcctactaatttagcaggcgacttccttggaactattatgactttttagcaagccatttagctagataacgattagcttgtgcagaacaaagcactttttcaccatttgtcatggttaatcgtcgcaagtgcttgtccaatgacttaatgcgtttcaagttaacaacatatgacttatgacacctatagaaattaggactcaaatcaggaacgtcctttaacagtccatagtattctaattcaccatcatccaaatggactacgattttatggggactggttgaactttcaaaaaatataatgcttttaacattaattgatctgaccgtctcaccaatttttatttgaacatagtcgtcttggtcattttcatcggtttgaaaacgatcttgcgccacgtgtaaaaccttgctaaatcgctcatacaaggaatctggaaaatccttaagaataaaatctaatgcctcaacttgatattgaaacaccatcaaagataactccgtgtgtgtcgtgataaaaataatcttgctgcgacggcccatgtcacgaatctggctagctagttgaataccattaatatctgaattaagggcaatatctaacacatagattgccttttgaggctgctgtgcattaaccttgtctaacaattcgtggggatcttggcatgctaaacagatactcatgtctagctgctgatcgacgattaccttagtaatgatttgccgtatttgttgtaattgtttcggatcatcttcgcaaatatagacactaatcattctgagatactcgcttcaccgtcaagcgttgtaagaataccgctcctaagactctggtttcgagtatcatgttctcattgcgattaacaatcttacttaaactattcaatccaatcccccgattcttgcccttagtggaataacctgcctctttcagcttccataagggtggtaactgttcaaaacattgttttgaatcaagaacaccgtactatttttttcgataaaaatggcactcataatctctccatcagcatgtcctaccgatgcttcgattgcattatccaacataatccctaatgcaatgtctaaatccaattcattaacagtaatgtcaattaatggttcctttaaatcaaaatgaacttcaatctcttgcgattgtgcatagctcaacttactaaataggatactcttaatcgacttcactttgactcgactcaaatcttcaagattatatttttcttttaacacccgatttgaaaccggtgcaagattcttttgataatattcttgtaaaccttctaaatcatcagttttcaaatattcatctatcgaaatcaacatattctgatagtcatgtctgaaacgtcgcaactcattatagtgagcttcgatttcattcatatagcgagtatcattttgtatttgtattctttgcttttggacttcatatttggctcttacattttttaaatattcgttataaatcaccaatactaaccccattacaactgacaatataattaaattacttaatataacctggaactgattttccagaccttcactcaacataatatacaagtatattatcattaataatagtgcggttatgcgatttaagctctgattactaaacgtgggactgaaattcgtgcgatccattacaatattaagaaaaattaagcttacgacactcaatatgacaaacactaccacatacccattaggaactttcattaaacgagttaatatatcacaaatatggtcaaccataatcgaccatatgaacacttgaaatgttatacatagtgcaccgcttagaactcgtacataccaccaagtgaaaaatataaacatcattaacattaaaaaagaaaaactaattcctaactttgctaaaaaaatataactcatcagcatacagacggataagaatataacatcaaaaagtctcacaaaaaatatatttctcaacaaagatttaattatcaaatagatagataattcttggaagacaatcattaacatatatctacactaatccttgctttttaattcatcaggaattttagtttcgaataatatcccatggcagcacataaccaactgtttagtacctacgtattgaaaaagatggctaagtactttatacattttttctttcataattttccctcctttcatagggcattagtaataaagcggctaatgccatcgcaattaaaatgattgtgccaaaataattattactaactatttgtaacaaactcaaaattaatgacaatccaattgcccgtcgctttaatttttttctcaatgacttcgatgtaataggattctttaccgtatcagctggagcaaaaatacttatgattattacaaatattaaacttaataacaatctgtatacttcagaaataccagttccaatcacatacggcacacccacaaacacaaagatagttaatatcgtacataacaaatccgattccaagtgacgtccataggcaaagccacgcaaaactaaaaaactacccataaaaactaacactgggaccaactcgtgtagcagcaacgctaagataatagtaattatcagcttaggaataacatttaatacagtatcaatgcctagtttaactagtaatgcctgccgtctttctagttgaagattcttttgaatcgcagcgaataaccgatcgcttaatttataaagcaatagtttttgttctggcttttccatatcccactcctataatgctcaaatacatacctgtatcaacagtttaaaacagtattaattaattgaaaagaatacataaatagattaattattcaatattgttttaagactagaaataaacatttaaagatacatcagtttaattattcatacgaaactaaagtttcatgtaaaaagatcgttaatataaatcagtttcatcgatactcccccttaatttttccttagattacaagtcaaactagacttaatttcactaattcacattactcaatagattaatatcaaatggtgaaaatcaacgaaaaaaggagatctatcaagcaatctcctcttacataaagttatttatgaacactgatttaagctaagctgccgatatcacaatctcagcatccactaaatcagccttcaagtttttgacatctaagtggtcaaggtagaaatccgttaccttgtcacgaatttgttgttcaattactcgccgtaatggccgcgcacccatcgcttcatcatagccttgttccatcagccaatctttggccgctttagttacctcaagtttgatggattttttggctaacgttttttgtacatccgccaacatcaaatcgacaatttgacttaagtcttgcttagtcagatgtgaaaattccacgattccattaaaacggttcagaaattctgggcggaaaaatggtgctaacttatccattaatgactgatctcgttgcttgtcaccacttaatgcttcattaccaaagccagcattagaagtagcgataataatcgtatttttgaaattaatgacattgccttgtccatccgttaagcgcccatcatccatcacttgtaacagtaacgttaatacttgtggatcagccttttcaatttcatctaataatacaatggaatatggattacgccgaacccgttcggttagagtattagcattatcttcatagcctacgtatccagccgaggtaccaattaatttcgacacagctgtacgatcagcatattcactcatatctagccgaataatcgcatttttatttccaaacatatctaaggctaattgcttagctaattcagtctttcctacgccagttgggcccacaaacagaaaacttccaattggctgatcaccctctgaaaagcccgcacggttacgccgaattgccttcgctaccatttcaaccgcttcatcttgaccgattaccttacttttcagacgcttatcaagatttttcaagtgctcaatatcattagcgcccatatcagcaactggtataccagttaaacgttcaaccgattgtgccacatcatcaatcgtggcagtgattttttctttttgatccgtttttttaattttttgcttggtttcctcgatcgacttcttgatatcagcggcttttgtaaagtcctccgatttaacggcggcctccttagctgcctctaattttttaacgcgttgatccaatgtctcaacatcagtttgcgaatttttagccgctaaatgagccgcagtcatgtcgatcaaatcgatagctttatctggcaaagtgcgttgtggtatatattggattgaataatccacagccgccttcaaaacatcatctggtaatacaacatgatgatgcttttcgtacagctttttaacaccttgtaatatacgtaaagtgtcagcggccgtcggttcattaatcacaacatcattgaatcgccgtgccaaagccgcatttttcaaaatagtattgcgatattcatcttgagtcgtagccccgattacagtcagctcgccacgtgacaaagcaggtttaatgatatcagccaatcctttgccaccatcttcaccaccagtggtgcccgtgccgataatctgatgaatttcatcgaagaatagaataatattaccagctgctttaacttcctttactagctgtttaatattttcttcaaaagaaccgcgatattgagttcctgcttccaaagacgataaatcaatcgaatagatttctttatcttgaatcgtttctggaactttaccagccacaattgcttgtgccagaccttcgacgactgcagttttacctacaccggcatcaccaactaagattggattatttttcgtcctacgactcaaaatttctgcagtttcttgaatctcattctcacgtccaatcactggatctagtaatccatcacgagcctgttccgtcaaattagtccctaacttttctaaaattcccccttttttaacagcctgtttaccatctttagatacttctattgttttattattttggggtagcttaccagttgctcggtattgagcaaactcatccggtgtcagcgattgtccattaactaaataccgtgcacgctccgaattttgattatccatgcgccgaaataattgattgaaaacatcatccatatcattgttgaaaaaaggatcatttccgtagaaatttgccatattacaacacctccataaaaatttatatgtgtaacttagtgaccataatatcctttaaaactacaactgaatcgtatcacgatttttatgtatcgttaagtaaagtgcttatagaatcaattagaaataattagaataattttgtttaaacaaaagagaaatcaatttcataaaatggcaaattacaagtttaatccgaacaagcccggaatctttcaatggcagtctgttgatgatgtatttttaatggtcgttgattaattagttcaagtgctgctaggatctcatcagtcgttacttggctaaaattggtctttttcgggaagaaccagcgtaaccgtctattaaaatattcattggaacctcgctcccatggtgaatatggatggcaaaaataaactttgatctgataatcctgttctaaggcctgataattggcaaactctttaccatgatcaacagtaatggattttacttggggaccgaaggcccccataaacttgccaaaggcggtgtttagagccttagccgttctattaggggctttgatggcccatagaagtcgggtcttacgttctacgaatgtaaccagacatgctcgtgacgctttccggccagaaagcaccgtatctacttcccaatgaccaaaagctaaccgttgattaacagttgttggccgttgttcgatggaagtcccacttgtaaatttcccacgattttcgctcactcggtgctggcggacattccgattgggtagatcagtcaatttgaaggggagccagccacgattaagccaattataaattgacgcagtgctcaagttataagcggccgcaatggtttctggtgaccaggttaatcgtaagtgattggtaattaaagtcgctaatgctgccgtcagcatcgaacgacgaccgcaattccgccttttgcgatctgcatcttgctgagctaattctggatcataaggtttaacccggtccaactcatagctaatcgtagctttggcgacgcctaaggcgtcagccattacttggtaagatttattcccctcattgaccagttgtgctagtgcgccacgttgaaaacgtgataaagtagatgtacccaaagtaatcactccctatattggttggaattagctactaccattgtaagtgattgctttgggcttttttaatttctgttcggattaattatagaatttgccaaatgaattgatttccctacaaggttccctatttaatagcccttgataaagaacttgaattaacaagttactttccagaccaattttaatttaagagactacgactcaaaaagcacacccagtatcaagttaaggccaactagttatccgcgcgttttataattaagttagccacccagccaaaatggtaaaaaaaagacaccaagacgaaaaattcaggtatcattgaagttcctacaacaaacaatgaaagaagttttcgtcttgctgcaagaacagtctatcacaccacgcccaaaaggtcaccatttatcggaaatcgaacgcggtcaaatcgccgcttggcacattgaaggatgctcagcacggcaaatagcgattcgattaggcgtctgccaccagaccgtcaataatgagctcaagcgtggtcgagtcacgcaagttaaacgcgttaataatcagaaacactactttgaaatttacagccctgaagccgctcagaatcgctatgaaataaagcggcaaaactgtggacgtccattaaaatttagccaagtgacggccttcttagcctactttgatgataagttctgccatgagggctggtcgccggacgctgctgttggttatgcccgtaagcaccggttatttaagccggccaaaatggtctgtacgaagactttgtacaactatatcgatgcgcaactgttggagatccgtaaccttgatctgctggaaaaaacaaaacgccggacgacccaacaccactcgcaccaacatcagcgcctactcggtcgtagtattgaagaacggccaaagcgagtagaaacgcgccacgagtttggtcattttgagatcgatactgtcattggcaaacgtgctggtagcgagagtgtcctattaacgtttaccgaacgtaaaacgcgctatgagattgtccgcttgatcgagggtaaagacgctgaatctgtggcttatgccatgcaaaatattacggctgaattcggtgacgttatgcggacagttacggcggataacggaacagagttcaccacgctaacggctgcgcttgagggtattgccgagacttattatgcccacccttatagctcggccgaacgcgccactaatgaggtccacaatcgtatactcagacgttactttcctaaggggcaatcactcgatctagctacacccagtctggtccgtcaagctgaatctcggctcaaccatctcccgcgccgcttacttaagttctgtacaccagctgaagtatttcgaaaggaattagcacgtgcgcgcaaaggccgagccgcctaatcctgatccacctggaactcccatgagccctttcgtctgtgtgctttatcggtactggctaacttactattgcaatttgcgccaactagttatcgttaatattgccacttaaatatcaatactagcaatcatgacacacgtgtaaaatcataaaccaaaacatattacatgacgtaacggcggtcttgggactgtaaactcacagtaatgattctattgagttggataaggtgccgatgaccagtaattgccataaatgcaattgctttcggtacaatcgtagtgacatagccaacagtctcggccatctgcccatttgttttataaaaccgtaatgagactcgacacttttgatcatgcgcttgttgtaatttacaataattattttcaacactcaaattaaagtctcccgtttaaagaattcaggtttatttattcgttagtgaatctatgtgtttgtttttctcattgttgacggcgtaagtccacattaaggagtcagttattcagtaaaaactaaataactagtattcatgttcagctcagtataatatgcattgatggttaagaatcaaaaatcgatctctaaatatcctaattactatgaaaactttgaagttaatttatgagaaaaataactcacaacaaaactcatgattacaaccttgtcatcataaccagattatgaaacattcagcctcctaaataaaactggtatgcgcgcatgtgcgcatgtgtacagtatactattgccaagtatgtctgaataaccgttttaagacttgaaaaactcagctgggtgctttaggacgctttttgtgcattttaagacaatatcctaacttcaacgccggcatagcttcaattcgtcaatcagtgtcttagtttctcagccatttctgttcagagcatcttcctattacaataaaaagcgttgatctcagcagaatttacttccaccaaaaccaacgctaaagtgctattatatcaggtattttaaattcatttcagacattatattcagcattacttctactacctaagtaatttagcacgtttaacatcttcaatcgtcttagttcccgctagttgcatatcgatcaacagctcatcattaaggtgactcactacggaagcgacaccctgcgcaccacccaatgctaatccatagataatcggccgagcaagtgccaccagatctgcaccattggctaacgccttaaagacatgggagccacgccgaacaccgctatcaaaaattattgggacacgcccattaacggcttgcgcaatctcgtgtaaaacatcaaaggaagctggaccaccatttaattgccgaccgccatggtttgaaacatagataccttgagcaccagccccgattgctaacaaggcatcttctggtgactgaatccccttcacaataactggtaaattcgtatattctgtaatacgccgaacatcagctgggctaatcttttgcgccgcagcagcatagatttccatgatacctttccctttaccatccccttcgctgaacttagtcaagttagccattgggattggaaactggaaattgttgataatatcagcttcacgatacccgtcaactgttgcatcaacagtcaaaatgattgccttagcaccagccttcactgcttcatccaataaactctgattgaaattccaatccttgctcatatataattggaaaaattggggcgcacctttaccagctgcggcagtatccgcaattgacgttgaagaataagtactctgagccatgagtgccccaacttgagccatcccttcagcagtcgcagcttcaccccgtgcatgtgccaatccttgagcggccgctggagccatcataataggcgttttgagatctatgccaaaagcctgagtctgtgtgcttggctgttccatatccgtcaatgctcgtggcacaatttgaacatggttaaaggccattgtattctgctttaaagtccattcgtcttctgacccaccactaatatagccaaagcctccgctcgggatgatctttttagcagctgcttccaatgatggtaaatttaaaatcgttaacttttgctcacgatcactctgttcatatccattaataactgtcattatactaatctcctttacataaccctttataattcatttaataattggctaagtgccggttgatccgcttcagcgataccatatcgttcacgatacttagcaatcgtatctgcatcaaagttttccggatctactggaacaaaactagtatcaattggatcaacatttttaatttttgcatcaatcacaattggtagccgattaccattctgctgtagttgagtaactttctggaacgttgctttcaactctttaaggttagtcactttaaaaccaatcgcacccatgttgtctgccatcttggcccaatcagcaccaatcaagtcaatcccatacggcgcctgattagcgagtaacttttcatgttgaataaagcctaatactttgttttctaaaaccacgttaatgaccggcaaatgatatttaacttccgttagtaagtctggcatcaccatggcataaccaccatcaccagaaatactccaaacctgcttcttaggataattcaattgggcggccaaacctgctggcaaaccaaaacccatcgtgccataccaagccgacatcgtaaaagtctgttgcttattcaatggtaactgtcggattgcccattccgtattattcccaacatccagaccaaagacggcatcatcagtagcattgtctttaatagcttctagcaccccttcagccgtcaaccctccttgatcatcagtagcaattgtcttgagccaccggttccagttttgcttatcacgttgagcagctttcaagaacttagttggcttaattgtcacttcggattgaagtaatgcttggaaaaattcttttgcatctgcaagaacagtaatatcagcatcatgttgtttgcctaaatctgctaaattgttattgacttgaataaacttaattccttgtggcaagtaacgtgcaaacggaaagttagtaccaacaaacaaaactagatctgccgcttgcgagacttcaaaggcgggtttagttcctagtcgaccgcgagaacccatgaaattaggatggtcagttggcataataccagttgctggagccgtcgacaaaaccggcaaactaaatttttcagaaactgcgataacttcttgacgcgcattataggcacccttaccaatccataaaacagggtgttgagcagctttcaaagccgctatcgtctgctgaacatcatctgatttcggcattaagacctgttgactgccgctaagtgaagccgttttaaaaccatcaaactcaatatcttgaccagacaaatcatctggaatgataacaacagaaaccgaacgggtcgcgtatgctgatctaattgcttcatcaaccacgtatggaatctgttcagccgttgtcacttgtttatgaaattcggctacatctgcaaaaattggatcttggttcatttcttgaaagaagttcgtattcataatggatgttgctgattgaccgactaaagctagcaccggtacgtgatccatcttggcatcgtataatccgttcaagagatgaacggcgcctggtcctgctgaaccaaagctaacaccaatcgtccccgttaatttagcatctgccgcggcagctaaagcaccaacttcttcatgacgtacttgaatatacttcaagtggtctttctcttggtagaacccatctaccgtattattaatcgagtcagctgtaataccatagatatgatcaatgttccagtcaaccaacacttgtgccaatgcttgtcctgctttaattttagtcatttccattaccctctttttgttgttacttttttaagcataactatatcctaaataaaaacttgacccttgtcaagtctttatcttaaattatgcttgttgttgaacagcgctaatgtcatcaataatatcttgcagcgtcactcgcgacatacgtgcctcagcactattctgaatatcacagtagtatttttccatcactcgcggaattaccgacccgaccggacacgtctccgaagtattatgatcaacgttcaaaaaattacgcttagccaccactgctacatagatatccttcaaggtaatatcattgggcgaacaagctaatgttggtctagcaacgccacgaaccgaagttaacaagcctgcttttcttaacttactcatcattcttctgaccatggtaggatccgtatttaaactactagcaatatgctcacttttcagctggtcatcagtatgcaacgcaatatatgccataatatgcgtcgcatcacttaattgtgtattagccatctagacacctcccatatccatctctattgttacttattttagcacatctaacgtgaacataaaagcgattaaggaaataagttaggcttctttccctaatcgcaacataagattatttgataatctccattaattcaatcaaacttattcaagacaccgatagtagctgaatttaaaacccaccctgtccaatttgatgttgcaaatcatctaagccaaattgttttaaataagttgaaagtggttgtaaatcttgagcttcataccgttgtttaaatgcttcaatatcagctgccgaactcattgccgaatctaaacgaagcttttcagcaggcagtggccgatctcctgtaatcaccgcatcaatcaggactggttcatgctgagcgattgctttggcttgttcaaaaacatcaggtaattgctcaatcttattaactcgaaaagcttgcatgtgcacgccatcggcaatcttactaaaatcaatatcattgaattcaacgccaataaaatcattctgattagtatcttcctgctcatctttgataaatccatattggcagttggtgaaaacaacattaatcactggtaaatggtattgaacttgcgtcgccaaatcttgcatggtcatcgaagcgccaccatcaccggccagattaaacacctgccgctcaggataattaagtttggcagcaattgctcccggaataccaactcccatcgtagcaaataagttagaagtaatgtgccgattggatggcgttaatttcaaatgtcgattcgcattcaaattgatatcaccaacatcaatcgaatagattgcatcaggctccgcaattttattaaccgcacgtagcacttgatatgcttgtaaaggcccttcctgcttatcttctaatgaagctagataagcccgccaatttttaacattggctaaattggcttgccaccaaggtgtcgactcccgttcagatacctgtgctaaaattgcagccagcgtcttttgtgcatcagcaagtaccgcaatatctgttttatgtcgtttacctaacttagctggatcaatatcaatttgtaagaaataacgcgtatttttaaacgctttggaaacttctgcaaacggataattattaccaacaaataaaacaacgtcagcttgcgcaagtgcctcattcgccggtttttgtgccacccgattagcagaacccaaataggctggataacgatccgcgacaatacccttagctggatatgtactcattaatggaattttcaacgttttactcaattgttcgagttctttaccagccttacgagctccaatgccatagtaaataagtggccgttcagctgcgagtaaagtctgtgtcaatctcgtcactgcttgaacgtcgggttctggtaataacggcgtttgataactattagcggaagcataccaatcttcagctggaatctgttgccatggtaaatcgactggaatttgcacaaccgcaacaccttggtgagcgtaggcgcgtcgaattgcttcgtcaataacatgtggcaacgtggcagcattgacggctgttacattataatctgcaacgtccgcataaatcggattctcattcatttcttggaacgtatccatgttcatcccagtagttccaaattgaccaataagtgctagaacagggacatggtcttcacgcgcatcatataacccattcataagatgagtgccaccaggtcccgctgagccgaagcaaaccccgattttacccgttagcttagcatcagcagcggcggccattgcaccaacttcttcatgccgtacttgaatataatggattcgatccctttctgctgataatgcgtccataattgaattaattgaacctccaggaataccatacaaatgatctactccccaagcttctaaaactttaataactgctgcacctgctagtatgttagtttgttttgtttgtttcataaccataataaagcccccatttcatgcacaatttaattacgcacaatttaataaacgaatattaccatagcaaacgcttacattcaagtggtcataaactcatgttttttaccactcaatcacgattcaaacgcattgtagatcaacaacagcactagtctgcttacctcgatgaaccaccatcgctgttgaaaattagtatctcatacattcgttttttaaacaattttagtaattagtgtatgttttacaggggcatacttccaacaatgtctgcatgtttagaagctagccattcttcgaaaactaactaccgctttcaaaacatgaccttaactcaattcgacacagagcaaaatagcatctgccaagttaattattcagctataatccgtaccacgctaccgactttaaaatcaggataatcgccctgctcaacatataacgtcccaggcaatttagcctcctttgcacccgtaaaactaatagccgtatggcctaatcttccaaggttagtctggacttcaccaccaactgctgtaatttgatagacttgattgtcgacttcaagtttcattcctgctgtgatttgctcacttattgggacaacttcgataataaagcaagaagtccgtaatgcgtctggagcttcatcaccaaataatactgccatgccaatcgatttaaaatcagcagattccgcacctatttctaagacctttgttgaaaagataattctctcttttgtcatcatacaatacacctcaaaccttctaaaaatttattttgaatataatccaaaacttgcaatccaagcaataaagacccgcggaacgccgttgataaaccgactatataacactgatggcaccccaacttcaaccgtcttagaatcagcctcagctagtcctaagccaactggaataaagtcacaaccattttgcgtgttaatcgcgaataatgctggtaatgcatactgtggtggaatattacctttcccgatttcaacgccaatcaaggtcccgataacttgaccgataactgcgcctggcccaagcaatggagataagaatggtaatgagcaaataaatcctaaaaccatcaagccccagacattgcctgctaacggctccatgacactggcaaaaaccttaccaattccagagccattaataatcccaataattaatgccacaaatgccataaatggaataatagtattaataactgtttgaacagcatcttttgcggcctgattaaacgtcgaaacgactcgcccagcaccaatcccaatcttagttaagatcccaggattttttgtttgtgctgttagtgtctttgtattatcgaatttcgtatcgtcatctacattctcaaattggttagcgctttcattttgactgtcagaaaattgctcctcctcagatgttaccaacataatctgatcaacatctacattggaaacataattagcttcattcataaattgcgctaagggaccgctcttaccagtcggtaatacgttaattgttttgatacccttcttgggataaattccacaccttaatgtcccaccacagtctacaaccgctaatgctgtttcttcatcaggaattgacgtcttaaagccatcaacagcttccattcctgtcaacttagcaatcttatcaacaattgctggtttattacctccagtgacataaacaaatttatgcttcgtgatagttggtgtaataattagcgggccaccccagccaccagagcctttaacaactttgatactatgatattcctttgccatgatctcattcctcactctctcaattagccgttaaattcaactttcttggacaaggtaatcccttgttgtttgcagacataggctgttgtaaagtcagtaatccaaccaccgataaagttcattactaggccgactaatagatatcgaatcgccaaatccattgtattcaatcctaacttctgaaccccttgcgcaatccctaaccaaatgaaatactcggaaggattgatatgtgggaataccccattactagtgtggcaaaattgagcaatcgatgcataccaactaggtttatagtattctggcaagaaccgtcccattgagtgcgccataggattaccgagcataaatgccgaaacaaacggtaaaattaaataacgggttacaggattctttgacgaagctctggccaacttggccatcttcttgtcaccaacaaaggcaataatcgcgttcatcaagactaacagcaatagcacaacaggaataattgatgtcatccatccaattaatgttttaccaccactctgaaacagccccataaagcccgaggccaaatctgtgactactttcatagtattaatgctcctttacgttcacttgtttttttcgcaaacttgctaagcctttataataaatagatttcagcttttcaatcattggtaggctccaaattttgacactaccatcgaaatcttgtggcgttagctgatttgctttgtaatttaaatagttcttataggcatccaatagacaaactcgcgttagcttatcgaattgttttaattgctggtatgaagcagcaatttccgcaatatttttctgccgaagttgatgcaattccctaaactttgcaaaaatcgtaacccccttcatcatttgagcctctaagatcgtgccgtcatcctttatcgctaatagaattagtgtccccgaccgtaattttttaggatttttgccaattgctactggcgccaacactcgtaattgatgaaaggttttagaaaaattcttaatttgtcttagtccaaggaaaccttgtaatagaaacgcactgactaggatcacgccaaaataaattaacattaaatcgcctccatcaactgatttaatccttgattttcatcataatttttcaagttattataaatattgctgttagctgtgatactgcgaattagatcgtatacttgtgctaatattttgcttaatgttgcatctagtttatacggaattgcgaccaaaaaaaccacgtttaccttttgattatcgaatactaccggtttttcaaacactcctactgttacaaggattcgatttagtccagatttatcaataacgtgtggcaatgcaaccccatcaccaaaaatactactcgattgttgctctcgattaagccaagcttgcataaaatctggtgtcagttgaccatgttgtatctcttgattaattaattttttcactccagtgacgtaggtctcctgttcatcaaactgcgtgacatcaaatcgacactgcccctgattaacagcttcatcaaccaacgaaatttgaagacgttcacgtaacgttccttgattaaaaatagaattcaaccgaataataggcgcgtggttaattaattcattatctgttaaaaaactgttagaaaaaatcagtaaatatttttctggactctgctcccattcactaattgagttaaaaacatcaatctgcaaatcatcatctaacatttctttcaatttctcggaaataaactttttcatactagtattaatgggctcaactagtgcaacccgatgaataattggcgctgccatgtattcttcaagctccatctgaaaatagactgttaaataaccaacctcctgggaacgaatccgaatattcaatttagtggcaatggttgataatgttaattgcgctaactccgttgaaactggatacttacttaacatgtctaccgagataaatccttctgacttgacatcaaaaatagcccgattaatgagaaataataaatgatatcgcaactccatcaacaaccgtttaaagtccaaattcacatctaatttttgcttaaggattggaaaaaccgactgcattaaatcctcaacttcgaccaatcccacttgaactaactgattatcatccttcggtagctttctgatgtttaatgggtatgaaataaattcccattcgctagtgcttaacgagctaccaattatctcagtaactagattccgcaaggacgccatcgttacatcactaagaagtggatgatagttattaatacgatcattgatttgaatgttatatttacgtaaccaattaataaccgcaatatttcttttaatcatggtcacagtatcattattatgatcaagttttttaacaagattaagcaatttgacatctgtcgctttatcccaggttgcttccagttcgtagtatttcccgactaaagttcgtgtaattactgcatacatataatcatgttcaaccgctaaatgaatcccacgattagtttttgtctcaattctgacttggtaataatcaagctgttgtttgagcgcttttaaatccttattgatagtgccacgactcacagccaatgattctgccagatcatccagaataacgtaatccgtgatttgctgtaacaattcttttaaaatcgttgcttgtcgctttgagggatcattgaaatctaaatcctttttcaagaaattagtttgtagcttagccatggcagaataattattgataactaggtaaaacttggcttgattaacgttgatttttgcaatacccaccaaataatcattgattgcacgaatattcttggtaattgtgactctcgaaacagaaaaatgggattgtaattctcttagtgtcaatgcatcattattaataaaaaagtttaatatttcaaaactttgcctatccattgcctcaccatgcccccaactaaaatttaaaggttaaccacgactcttgcctcccgcaacgttaatcgtaaccccggtaatgtaactggcacgttctgatagtaaatagttaactgcatccgcaacttctgatagttttccactccgaccaagaggtgtggttgacgtactcttatagcctgcccgaatgtcatcaacagttttatgccgggtataagctaacgcctcttcataagagcgtgttcttagcccagtagcttccataatacctggcgcgacaccaacgacccgaatattatgttcacctaattctttagcccacgaacgagtgaacccattaatcgctcccttagttgctgaataaacactctgtccttgtgaacctccaagtccagcttctgaggacatattaacaataacaccgtactgttgcttctcgaattgacgggtaactgcctgcgatacaaggaagacgcttttcacgttcacggcaaacattttcgcaaaatccgattctgcaaattcatacttaccgtgaggatccttggcgtcagccaataaacgtggcaaattgataccagcattatttacaagcccgtcaatttttccttgttcatcaacaacctttaagaccagccgattaaccgcttccgcatctgtgacattggtttcaacaaagtgtaaattatcattttgctgatcaccttgattgaggtcagcattataaacaatcgccccgttattcaataattcagttacaattgctttaccaataccggatgagcccccagtaacaacgtataccttacccgaaatattaatccatgaattattcatcaaaatcgctccttaatcatttcttttcttcacagataaatatatacgaaagcgcatacattattaatgcactcttttttcattggctttttaaattaatggactaatgattcatcaaacatttagatgtctgatataaactataaatattatgccgaattattttcattatcgccatatcataaagcaaattttgtaatcgactattgtaatcaataaccgtaaaaatagagtcgctttaaagaagcgtataactccttcaaagcgactctattaaatagtcttatagccatattaatttgttttaaatagtcaccgtaacagctgctgccgcaataatcagtatcagtccaccaatcgtgacccacatttctttggtggtcttcttttggcctaagaaccaaataccggttaacgttgccaatacaacggaggtttgtgaaagaataaagccggttgctaatccgttcatatttggttgcgcagagattaagtaagtcaacgccgcaaacgcgaagaagaaacctgagatgatgtgcgtgtatgacaccccttcaacgagggctaacttttcacctcgtgatgctaagaacaaggcatatacgatcgaaacaataaccatcccaattgcttggggaacgaaggcttcctccccaccaatattggttgcttggggcgcagccgaataagcccagtacccgatttcaccaactgctaaccagataacagcttggcgtaaggtccgggcgttacctgcatccttatgttcagaccacactgttagccaggcaccaatgataattccaactaaggctaggccacccaagaccttgtccattgccccaggccagtcacctaaggcgaagacgccccacagtgatgcgcccaacagctggaaggccgtcgtaattggcattgctcgtgaagaaccaaccatcgtaaacactttaaatgtcacgatttgggcacttgcccaaccgatccctgatagaattgaaaaccagagattcatgccgcttggaaaagcaatcccttgcacccatgcataaatcagcgcaaagattaacgttccaatagttgaacccaagatctgattaacaggccgaccaccaattttcgacgcaatcgtggggtaaagtccccaaccaagtaacggccctaagccaattagtaaagcggtagtattcattccaatccctccattaatcaccaactactttaaaaagtaacgccactttccaatagaatatttgaataaggtgtcatttcaccagtccgaacaaaggccttgcagtcagccaagtccttcttcatttcttcatgtggaatgaaggtaattggggtgtctggtaagcgcttcttgatggccgtcaacatcttaggattttgaactttaatttcttctgccaaatagattcgttgtacttcaagctcttccaagacgttattcaagacttgcataaaactaggaataccattatcaacggctaaatcgattttttcggttgaacttggtactggcatgccagcatcaccaatactcaacttatcgaaatggcccatcgttgcaataactcgtgacaaatctgaattaataacttttgtttttttcataattatttaccctccgcggctgtaatttcatttttataaggaattgatggttgcgcaccgaaacgttgtacggcaatcgatgacgcccggttaccatagcgaatcgcatcttcaagattactaaaatctttatttaacacactactcatcgcgccaataaacgtatctccggctgaagtcgtatccacggcttcgactttaaaagctggtacgataccatgtcgcccatcgatatcataaaacgcacccttactaccaatcgtaatgataacagctgaaataccgagggcgtgtaatgcagcggacgcctttaacatgctggcttcatcggtgattgcaatcccagtcaaagtttccgtttccgtctcatttggtacaatcatgtcagtaactgctaaaagttcagcggggacttttcccatggctggagcgggattcaagattgttcttacgccagcggcctgtgcaattttaaaggcttcgaccgtactatcgacagcgctttcaaattgtgcaaccacaaaatcactagtttcaatgatatcacggtgggcttcaacgtctgctggcgtaaaggccatgttggcaccaccatgaatcataatttggttttcaccggcatcatcaaccgtgacgtaagcttgacctgtcgattgattagtcatctttgtgatccctgccaagttgatcttttcctgcgtcaataaatcaagcatggttttaccagcagcatcgtcaccaaccgcaccaataaagtgggtattagcaccagaacgttgcgctgcgacggcctggttcgcgcccttaccaccaccggctgaaaagatttccttagtgtgaatcgtttcgccgggctttggcatgttttcaacccgaatcgtccggtctaagttgatactcccaataacggttaccgtattcataatggtccctccaaatagttaaattaatctgaatttagtttttattaaaacgttttatgaaaacgttttaataactcgtaaaaaatataacacatctgaataattaattcaaatgtgccgtcgaatttctttcaattaatttaactggtaagtggtgttcttcccatggctgctgcggattagcaatacggtcgagtaactggttggctgtcgtttgccccaactcaaaaatcggttgtgcgatggttgtaagctgtggcgcgacatattggcacatttcgacatcgtcatagccaatgacactgtaatcatccggtatccgcttatcatgttcagccatgcctaagtatacaccgaatgcgatttcgtcattgactgcaaagatccccgtaactccagtcgccaaaatttccggaacaacttggcgaccacccactttagaaagcggcgtcgcgatgacatgtaccgctgtccgcggatacacactataaaaaccactaagccgcttttggacattggctgacggttttgctggaataagaacggcgacttgccggtgtcccaaatcttttaagtgttgagcagcttgccgccccccatcatagtcatcagtcaacacagaatcactgaacccttcggcgcgcttttggtctaagacgataaatgggtgacccttttgccgtagaatatcattaatcgcattattggaaacggccgaacttgcgataataaagccatccacaccccggcggctgagttcatccaaatagacgcgttctttgtcttcatccagatcagcattacacaacatcgtgatgaaattttgctgatacaagacattttcaatgcctcgaagtagctcaccaaaaaagggattccggatatcaggcacaaggaccccaattgttttgctggtcttcttaatcatccgctgagcaaagtaatcgggctcataatttaattcatcccgggccgcttccaccttagcaacggtcgccgcactaaacttatcaccatgcccgtttaaaatttgtgacacggtcgcaattgagcgttctgcaaggcgcgcaacatctttgattgtgactgccttatttttcatgggcttctcctccgtaaaattaactcttgcattattgtagcctagaacgccgaattttcctaaccgaatctcaaaaatgttaatagccatataagtatatccataacgattcaaagattctaagccactcacgtccagcatcaaaagcgtccagattaaaactgcgtccaagaagcagccataccagttgcctcttggacgcataatatttttaacgtaatttccccttgttaccagcatagacacatctattacaaaccgtatagcgtatcccatataccaaagttaagcccagcttgcaaaaactagcgcgttcggaatcgaccgaaaatcacagcagatacatgaactgttcaatatttaaggcgtacccatataaataccttaatacgctccaaaacaaatttatttgccgtgtgtcgttttctgagcattatcctgataatcgttaaccctttcatcaacttcagcctcgtggacgataacttgtgaatgatcaccattcaatgctgcggtcgcttgttgaatagacttctgtaaatccgttaattctgtcgtcattatttttctcctttgcataccaagaaaatgggcggtctcttttaaccggccttcagccatccaggccctacctatctttcaaaaaagttgctttataatacggtcatatctgactgctaaaagcctaatccgtctttgaaacaaccattcaacaacgacttaattctacttcgttccaaactagattcacaaatcaaatataccctattttcaattaagttgccctgtcccacattatccaacatttaataagctcgtatcgtcacattcatcagactggcagcgtttaccaggctaaaaagtgtcacaatctcaacgtttcgtcacctgagtcccgtgcgtttctaactccataatttctcttatatatttaaagggaaaagggacaaccgtatactggccgtcacgaacatatccactatccatcaatgttgatagtaacggcataattctttgaatatctgcctttggttgcatactatcaagggcaacaacttgtttcaaactagtggcgcgagttaaatcttgcttgatgatttgattccggccgacatagtaatagtagtccgatcctaacatcaacaacccaattccgtaaataccattccaccaatcatcataaatctgttgcttgacaggcaagtgtaaccacacatgcgcattatcgaaaaagcgttgattaaaggtagccattaactttggacgccaactaagtgtcggtgccgtttttagtatcttttgaaagctcccaatagttattgtctcggtattgatccgttcaatcttcgtgattaatgcttgcttcaactctcgattacaatcatctaattcattagctacttttaatagtgcccagcggtgaattgagtgatgtgacctagcttttctcatcattgcattaatttgttctgcattcggaataattcgtagtgctgtttctccaagcttatataatttatcctcatatgctaatattttggtgaatttaagcgtttcccgtccattttcctcatcgaattcgtgaatcactctttcaaactctgccgacagcccccgctatcccttagtagccttctgagatgttaaatttccggcatcgtcgatttccaaacgataatatgccttgtcagccatcatataatatcggaatttggcggcagcagccatctcatcacgatttggaaacgtgatttttccactcaaaatatcctgtttaatcaatagctgactgagtaacgtccgtatttttgcgtcttctaacaaatgtactttgtttcctaaatataaggcgttacctgccaccttctcgttaacaaagtttttatagattaaatgttggatcacctgatgtggcgtattcttttggtaccgcgaatcctgactatcatctagaatttggatattgagcccggtagtcatcgcactgtcagttataattttaatctgacaggttgctaattctggcgtgcgctgccatagtctgccaaatgattctgcgaactcccgttgtgctgctgattcaggatcaatcattagcgtcactgttttatggataagttggtcaataattcgtgcccgcttcagaggcgtaacgttctttttatcgacagccatttcagttaggcaactgtgtgcaatcggccccgatttgaaacacatccaatactgcaattgcgtcagacttaacaatttatgcaacgtactgaccttgtcttgttcataatcactttcctgaattgagaaaaagttaatgagatttttttggttatcgacacttttaagtctaaaaatttgctgtcggttccggtattgccatttcatacaaccttcgctcactgcatagccaacattgaccgtatcatcctcaatctccgtaaatgttcgacttattaattttaggacatgttgatcaatcataacctctaaggccacccgttgctgtggcttttcttttgtgtgattaggcatgattaagaagagtctatccgttgcgttaaagttacaccagtctcggttttcgtccagcttaccttgaaaacgacatttcattaacataagtaataaatcgtcatcggtgataccatactgccctaactgttcaaaattaacaaacttttgttgaatatcagggtccgtagccatgattttagccgtgcgactaatcatcatcagataccgcgtttgtctgacgttgccattgatcattactgtaagcttcttaattgcgagtgcttgtgctttcttaaaccaactacctaacttttttggaatttgtgttgtaattatcgcaaatctaaattgttgattaatacccggatcattaaactcaaaatcaatgtagttggttttggctggtttctcttcagtattcatgaataaatgtcgccaccttctgcttttcagtttcggttaacacaaattggccttggcgattgagtaaagcaggaagctccatcactcgttgtccttttaataaatgactagtaaaggtgaggtcactatcgggttctatcagattgacaatcaacactttccaatcatctctaccagtcatcttgcatactcgtgccagttttttcaacacccaatcttgttcatcatcgttctcactattatgaggatagcgccagtttttaacatcaactagcacccgtttatcgagttgaaagtcaaacagttcattcagctgattccccagtagactagttcgatattgccactgatccttaattacaaactgcgcgctaacctcacccaaaatgccgcaatagttgtcaaattgtaccggattcaagatataattctttgattcccattcaattgcccattgattctgtttaaaatgcgccaacatccccggataagctaataggattggcagccctgccgcagctgcagagatactttctcggccattattgttttcggggaaatcaaacatctcaccatttcgttgcacatgataagcattcgcttgcatatcaagataagcaaattcaggttggtctgtccgctgattattcattagcgtcggatgttgcaagtaaaattcacgcgccttctggtatcgccgtgcaaccacagctttcacctgtaagtcgtgcttaacttgattaaagaattcctgactctggttagtatgattacgccaacgttctttttttacaacttcacttgtcaccactcgccagtgactttgccgctgatagtcttgcagcgcttgcgcaattggtcctaattggtaaggcgccatcgatgtcacgttataataatctaaaacgccatcccctatcataacagtcacttcagcaactttattaaacgtgcgatcaagtcggccgatcgcttgtaggatacactgtgtttgtgcgccgacataacttaccgtgtttcgaaactgtttgattggtcgcccccgactccgttcacgcgcatatgttttgatatcatttaatgagatttcatccgcatcagctagttccatatactcataataaccacgaatccactgcttcgtattcgctttagtggcgcactcaggaatcagggtgagcaagtgcgttatcgctccaagatagatcccatcaatatcaatttgcttatatcgtggatcctgaatatcagcgtcctcaggggcaatattaataatctgcgcctgatctggttcagtattcgctcggaccagattaacccctacccccagggttttgtatgcgcttagcaaatacacacgcgtttgttcttcagaacgtacttttaaagctgcggccacttgttgttcaatcggttcactttgcagctttttggcaatcatatgaagttgcggtaaatgcttttcgtccggacagagaaggcctgcaagtagttcaaatacttgctcgattacctgaactgacattttaattgtatctacttctgtatctaactttggtagaacactttgtagccctaatacgacccgtcgatttcgatgacttagaaaacagataaagcttccaaataatgatagataccgcttttggcaataaagcgcattgtcgctaactttttgcttcagctgctgcattaactgctgtacaagttgttcgagtaatgctaattgagcgtgattatcatcattgatttcaaaatttgggtgatatttcaaaatcaatttttgcataacccggatatcatctaattgatcaggatcaggaataacatttatcacgttgacttgaacaccttgctcccggcaccgggaactaacatccatatcttccttggtggctgcaggaactaactccgttccttttataaacgcggcacccagttgttgctgaatatatttgaaatcaaaattgctaatgactgtttctaggtcggcagttgcagatagtcccagaacacgattactgcgagctaatttcagcaaaaattgttctggcgtcgtgtatatgaaggccgctccgatctccgttcgattaagatgcgcatcactatcagtcaacgaaaagagttgcatgccatggtcttgtaataatcgcccataatggccgttctgcaagttgtcgccaacatttccccggatgtttttcagagcttcgatttccagtaaaacaattttttgtgtctcgttagaaagcctcaaagtatcacaaatagtccggacagaatcaacaaattgataatagtcttcgacttcactacgccgttcattgatccgtgcttgatagcttgttgcccactgcgcaatttgtatcacaaaatacttaatgaatttattaacatcacggaccattccatagaaatttaaattgcctttggccggctcagtcgattgtaatgcgacatatttcccgtctggatcatcacgactccaccacgcactactactcgttatctgaaggtgacttaaattaaagataaaattagttgctgctggactcccctttgttttatagtcttttaacaatttgtaagctgttgctaattcattggttctactctttagattacgtaaccgatgatccttacgtaaaacagtcatgatatccgctggacggcgcttctgttgatcattaaccccggcgtaaacctggcaaaaaaacggctgaaaatcaattggaatcttcagggcatcatcaattattttattgagcaaaatcggttttaacccgtcaatttcgtcaaaaataacagttgcttgattcaatacggtagggctactaactgtaattgagtagccgccccaaaaggatatatatgaacgaataaacttatcagcaaccacaattatcaattggcggttagctaaatcaatggttggaaaataacgattaatataggctgtcaagggcgtctctttgtcacggacatgccgtttaatagtctctttgtcactttcactgataggttctgcaataccgacttccttgataagctgttgtcgaatcgtgcgttgataattaatatacgcttgcttcaatccatggttattcggcaaatactgtgacttaacatcttcacccatatgcttaaattcatcataccgctgcgctaatgtctccaaagcctcttggatgtcccggtagtgttctaacgttttaggtaatttttgtgtcgttattatattgaccatggtcggtaatgaccgtaatactgcaaccttacgcgtatagaacatcataaaatctgactgactaactttcagttcacgcgttatccattcacgtttaatcgattcataaaaacgatccgcatgtaagcttttattctgattagccacaaagcaaaagcgctcatcagtataaacaattcgcctgctaatatgttgccgtaccgcaaatgtcttgccactcccagtaggaagcgccaaggtcatgagagcgcctgtccgatcaccggcctcagacacctggttcatagaagctaataatgttgcaatatctaatgacaatatagcgtcctccttaattccattaccgtaacaaacggttaggataccatcaacaggatttaccaaaaaaatacacaatatttaacataaatatacatttttagttttgtgtaaacttacgcttaatcgcccaatcaagtagtcataaaagaacaaaaaagcccgcgctcatcatgagcgcgggctcccttaattcacaaagggctatttttcagtaccttggccgtcccattcacgttcaataatcacctttaattcactgattaaaggttcgcgtgggttagcggtcgtgcattggtcttcataggccagttcggctaattcgtcgacggtggcgtcaaagtgcttcttttcgacccggttggctttcaaggataaggtcacatccattgagtgagccaagtcaatgtaagctttaactaagctttctttgagttcttcgtcggtcttgcctggtaaccctaaggcccgggcaatgttggcatagtcggctaaggcagtattatggttgtacttcggccacattgctaacttcgttgggatttcagcattgtaacgaacgacttgcggatacgtgatcgcaattgccaatccgtgtggtaagttgaattccccgcctaatttatgggcgatcgagtggttgatacccaagaaggcattggcaaaggccatcccagctagcgttgaggcattgtgcatcttctcacgagccatcttgtcaccatcataagaagctttcaagtacttgaaggctaattgcaaagcttgaattgaccagccgcgtgtgaagtcagaagccatcgttgaaacatatgcttcggttgcgtgggtaattacgtcgagaccagtccaagccgtcgtccgctttggcaccgtttcaacaaattgtgggtcaacgatcgcaatatctggttgcattgcgtagtccgtaatcgggtatttgacgtgcgtcttggagtccgtaataaccgcgtatggcgttacttcagaaccagtcccagaagtcgttggaaccccaatataagttactttttcagatactggtactttgtacgtccgcttccggatatccaggaacttctgtttagcacctaagaaggaagcttctgggtgttcatagaagagccacatccccttagcggcgtccattgcagaaccaccaccgagtgcaatgattgtatctggcttaaaggccttcatccgggcaacccctttgtagactgtgtcagtcgacgggttcggttcaacttctgagaagatgtcgatatcaaccggatcagtccgcttgttcaagaccgccgttactcgatcagcatagccaaattcaaccatcccaggatcacaaactaggaaaaccttcttaatcccggccatgtgttccaagtagcgaacggaattgcgttcgaagtagactttgggaggcattttgacccattgcatgttattacgccgttttgccacagttttgatattaatcagatccatatctgtaacgttatgagaaatcgagttgccaccatatgatcccgtgcccagagttaatgaaggcgtcatgttattgtagatgttacctaacccaccaactgaagatggcgtgttaactaagatccggcaagctggcatttgtaagccaaattctttgaccaatgcatcatcggtcgtatgaatcccagcagtatggcctaagccaccatagtgaagtaattcattagcccgtttgaacgccgcttcatgcgaatccgctttgtaaacggtcagaactggtgataatttttcgccggataatgggtacttgataccgacaccattaatctccgcaatcaagacccggcagtccttagcgacatctttcaagccagccatttgtgcgatttgataagctgttttaccagcaactggaccacgaactgtgtgccggttaggatcaatgacagcatcactcaaggcttgcacatctttaggtttaacgtagtagcaacccaaacgaataaattcagctttaacttcagcataaatttccttgtcgataatggcactattttcagaagcacaaatcatcccattatcaaacgtcttcgataaaacaatgtcgttaaccgcctgcttaatgtcagctgttttttcaacataagttgggccgttaccaggaccaacacccagtgctggtttacctgatgagtaagcggctgtcaccatacttggaccaccggtagccaagatcgtcgcaacatccgtatggtgcatcaaggcgtcggttgcttcaatgcttgggtgttcgatgtataaaacagcatcagctggaccaccagcagctttaatcgcttcccgcatcacatcagcagccgcagaactacatttctgagcttgaggatggaaaccaaagacgatcgtgttacgcccctttaatgagatcaacgtcttgaaaaccgttgttgaagttggattcgttacgggtgtaaccccggctacgataccaactggttcagcaatttccattagttgctcttcatcgtcttctttaatgacgccgactgtcttatcatggcgcatgctgttccagatatattcgctggcgtagatgttcttaatcgccttatcttcaacaacaccccgaccggtttcctcaaccgccaacttggctaacttcatatgattgtccagtgcggcaaccgcaaccttttcacataaatcatcgatttgtgcttgggtatatgacttcaaaatagctaatgctttcttagaacgttgaactaattgatcaacttcgtcagtaactttgcttgtttgatttttttctgtcttaatcatgaagtgcttcctccgttcaattcctttgtgaattaatttacaaactttattatagccatccttgctcataatgcaacaagaatttgaaaaattatttaatatcatccaaacagtacacttataaactcatgtttagcagtatttatagccaataaaaaaattcaattgttaagttcattaatgaacaatagcagtcaaaaacaaccgcaagctcctcattagccatgatgagcttgcggttgttaaaatttcatcagcttggatcttaatccctgtcccgagtcttgattaccgaacaacgataactgaaataggtgcttttcgggctaaacgcggaccaattgccccagcaatcttagaatgtggaaattcagtatcggcaccggtcactaatagatctggtttaaattctggaataacttgctctaaaatgacgtcatccacatcaccgccttcatagacaagcggctctacttgattaacgcctcgttgttcagcaagctgaacatactcggcaacaacatcttcaacgtgtttccgtttagcttggatcttcgacggtgttaatgaatcaaagatattgatatcttcgctttccagcaccgaacaaattcccaacggaacatcatagtcgtgggccaaagtcgttgcgtatcgaaacgcacattctgaagaggtattatcgtcctcatcaacggtcagtaaaattcgccgatagacaagtggctcttgcattttttgattttccatagttaatctcctcattgaagtgaattgatattgaccactgccattataccagtttcagaattcaaacggcaccatttctcacacgcatataatcataagctgatttccttcaaacgccgctctaaataattaagggtagcttttaacgctatgattccagccaccagttagagcggcagcactctccccattactccggtaaggctttcaacgtctgcttcaaccaattcacatagtagtcttctcgtccgatcgcatgttgtaagatcaaatagtgaccataatgttgcttagcagctttagcttgcgggaaaacggtcgccaatcgctgttgtaagtgtgctaacttagctgtgtgcagggtgagctgttcctgtaacatcgctagtaggcgtggatcacgatccgtttgaataaagtatagttttaaaataaattcatctttcgtagcggttaagtctggtgtaccgacactgatccactcatgtaacagctgccgaccagttgcggtgatgtggtagagtttcttttcaagtttttcgccactgaccgtaatttcatgcgtgacgtaaccttgttcttctagtcgcttcaattgcggataaatttgactatgttgagcttgccagaattcaccgatctcgtcatcaaaggctttagttagatcatagcccgttaatggttgctggtttaataaccctagaataataaattgtaacttgtttttttgcgccattggaaattcctccttgacgattccttgataacagtatacactaaccttgttgtttaaaacatgtaataaattacatgattaaaatgacatattagatataagaaaggtaattctaatgacaaaaacttttaaaacacttgatgactttctcggcacacactttatctacacttatgataacggctgggaatacgagtggtacgccaagaacgaccacaccgttgattaccgaatccacggtgggatggttgccggtcgttgggtcactgatcaaaaagctgacatcgtcatgttgaccgaaggcatttacaaaatttcttggactgaaccaactgggactgacgttgcactagacttcatgcccaatgagaagaaactacacggtacgattttcttcccaaagtgggttgaagaacaccctgaaattacggtcacttaccaaaacgaacacatcgatttaatggaacagtctcgtgaaaagtatgccacttatccaaaactagttgtacccgaatttgccaatattacttacatgggcgacgccggccaaaacaatgaagatgtaatcagtgaagcaccttacaaagaaatgccgaatgatattcgcagcggcaagtactttgatcaaaactaccatcgtttaaataagtaatgtttcacgtgaaacattctggtctacaaattggataattagcagtctgtccaatctttgaaaattactaatcatctgaaaaacattcatttagcaacacttcaaaaaggccttcataaatgtcatgacatttatgaaggcctttttcgtaattattttacttaggcttccgttacatccagtgcgacctgtcccagcccggcatcgaagtcggcttgccagtgccccgcggtcaaatgtggtggtaggacaaacgtccccgacgaaactcgttgaccagccgttaatgtcttaccttgctctgcaagcttgccgactaaccacttcaatgactcaagcgggttacccaacacttcactcgcttgaccagttttaaccgtctccccatcatggactagcgtacactttggcgttgctactgcatcagctgaagcgaacaactcggcagtctcccgttcagttccatataccactagcccaccgactgcggcatccgcgaccaccaaatttttaggcaaatcgggaaaccagtcagcaaaacgtgaatctggcaattcaagtcccggcgcgacagtcgttttttgccataaatcggtcaatgaatcggtggttgacagggcttctttagccttaaagaccaactcaacttcgacgagtgggtccattagttgcccgcgtcgaaccgtggttggtgccgccaaaaagtgatctgcaacctgggcaccgtacagcggcgtatgagcatcaaacatcttttgagtttccgcactcgtcaacgagaccttgtatccgccaaccggctactgttttaaggccgttaacgcggcttgaactcgatacgcagcgtcttcgtcagcgacactacttgtaaaatcagccattgttaacgcatgctgtgtctgataggccgtaaatagctgttgtgcaacttgagtttctgtttctgtggtggtagttgtcattataaaacctccattatgtgtttgtggttactgttatcctaatatgtgttcgtaatgaggccgtctaatcattgctaatacgttaactcattacaattaatctagttgtcacttcattatttggatgtattcattcagtgcgctaacttaatcgtacgggcgtcttaaatacgaattattaagactacgggtcataaatatcgttcatgttaaaactatgtgtgcctaaacgtataaattgcacgttgctaaaactatgtgttaatcgatacacgtagtatcgtatgtgatctacccggagtactcagttatactatgtgtttttgattccttgttgacctatgtgttactcgaggagcaagtcctcgtgcgactagttaccattgcccacatttgttggtaactagccacctgaatgtccgattccatactcctcaccacctttaaatcataaaaaaacgtcctttaactaactcctatgagttaattaaaggacgtccagaacgggttaccacctttattcgcgactacttcacaatagtcaccttagtacgtacagcaattgcgatacgccggtacattaatgggtaccatccagcaccatctccacgaatttcgaggcgcaactccaaggtgatctatgttaagtggtattgactgccttacaccaatccgcagctcgctaactaaccagcttagcaccgttccttatcacggtttttaatctaaatttaattaatgattagattctagcgccagattatcacaatgtcaaccttaaaattaaaaataaattagattaattaagcttgcgctcattggccataacatccactaatgccacgtactgctcagtatgcgtatcacgcaacgtataatttggtgggagcgcgtccgcatctgctttgacaattcgaaatcctacttgcgcataaaatcgcagggcattttcgttggccatcacacacttcaacgtgagtggttcggttgcatactggcgcatttctgtcagtagccgttcaccaactttcaagtggcggaaatctggggccacaaaaagcagatgaatgaagttggccagccggtacaacgaacaaaagccagcccgctgaccatcaatccacgcgaccagcacgaattcaccacggctgtcttcgttaaaatcttgcagttgtggatcagtgacccatggaaaatcttgctgacggtccactaaatatatttcagccagcgctgcttgatccgcagctgttgccggttttatctcaattcgtttggtcatcctgcgccctcccccatttaatgattctcattatgacgttagttgttgagaatttcaaacattaatcgccttaatctattcatcaaagctagctttcaactactgacaagcgttataatgttaggcaatactttcaccaaatgaaagcgggggaaaaatgaaaaccgcaattgtaacggatagcgcaagctacctctcagcggccgatgttgaaaagtatcatattcacgtcgtcccaattactgttatttttggtcaccaaacctacttagaaaacgtcgaaataacgtccaaagaattttatgaacgaatgcgtaccgcgcctgagttaccaacgaccactcagattacccttggtcagatgcaaacgacttatgatcagctggcaaaggcgggctatgatgctgtcattagtatccatctttcttctggtatcaccagctttattactaatctcgaaagttacctgccaaacgtaaccaacatcaaggtttatccgtttgattcactaattacggctggtggagaagcttacatggtcttgttagctgctaaattagtcactgaaggatactcacccgaacaagttattgctcagctcaaaaaaatccgtgaaacaaccggcgtatattttgttgtcgataatctcagtcacttggttcggactggtcggctctcaaacgcttctggactcgttggcaacctcttacgcattaaacccgttctgacctttcaagatggcaagatcgtcgctattcaaaaagaacgaacgatgcggcgggcatacgcagccatcaaagccaagctggctgccgagattgctgccgttgactatccacttcgcgtcacaatcgaaaacggcaacaatccgaaactccaagccgaatggacagctgacttgaaggctagctttcctgatctcaccatcgatgaaggcgagatcggtcccgtcgttggggttcacgttggagaaggcgtcatgggactgatttgggcgcgtgactgggaaaaatggaccatttagttcaccattatcaacccctgataattcatcatgacagtcaaaaacaacttttgttcctcacgacgagctgaggagcaaaagttgttttttgcattgccttatttccgtttcttgccttttttctttttcttgttctttttccgctttgtgttgggctgttcggccgacttagtcaacaacttccgtgcctttttgatcaacttagatcgttgtttggtatccagctgttcccacaatgttattaattcggggtcaacggcaggggttggcgtgaccgatactggaatcggtaccgcttccggggccaccgctgttgcaacatcagtcgtacctagcagccaatctggcgacacattcagtaccgccgctaacgccgtaaccttatcatgtttagccacgtatttattacttaaccactggctgattgatgaacgaccaattcccgtttgtttagataactgagcagaggttatgttcgcttgttgcatcgcttcttttaatcgttctgaaaatattcccatcacattaccctcctagtgcaacggatcccatgcgggtagccgctgtgcacgttcgttaagcagcgcctgaaattccggtgccaagaaatgcttgtgaacaactacttcatagacgtactcattaaaccaatcttggctcattacgaagtagcctcgatcacctacttgctcaccccaactattttcgaccttccacttagttggcgtatcagccactaagtcaacgccggttaacgtcatggcatggctaacttcaccttcacctgttaacagccgttgcgccttagtcagatgatcgttggttccaaataacttgccagtttcaaataaatgagcatccaagtatcccgtcttccggtccatctgtcgcaacacatcgttgccaaaccaaaccgtttcgccagcctgtaactgttgcacagcaacgtccgtcagcacacccatatcaaggttcaaaaattcgataggcttaccaccaatcacgttatcctcgtctggcaagctataaagtcgattaaacggcttatctggtgaattagtaacgaccacgtaatcatccagatcagtttcaaagtagtcctgatagaattgctgaggcgttaaattagccgtacgatggtactgttgctcatcatcacgatattctaaatcaaagctagttggtggttcaccaaatgagtacgccgtcatccgatagaccgtttgcaacattgatttctccagtgattgtagctcggcctcgcttgcaccatccatcacgagttgccgaagttttaacccatctttacgaagctgccgtgataaactggcttgaaatgccgtcgtattatcagtgttgaaggactctggcatcacactagctggaacgacgccatacttttgaaccaagctggccgccatcgcccactgaccaccatcttcgcccggattagcaaataagaactgaacaagccggtcatcaatcggctgacgcgccgtttgttcaacattccgataaaaaatattagccctttcaatcttatcccagaaaaacaaatagttttgtgataactcaaagtctttgacgtgataccgggtcgcaaacttatgccggagcgtgtttaataatgaaaactcccagcaacgaccgctgtgcttctgattactgaccttacccgttggtacttcaacagaaaaagtccgcgctaagcgactcgcagcttgattatcaaaacttgcagcctcaatcccattcttcgtaatcgctcgcgtcaatactggtgccattcgatcctgcgcatgcgttgtccgtaaagcggcaagtgcatccggtgttagttcagttgccatatttaccagcctccatcgtgatacttgccattattctaggcttattgaccattaaattcaatttagatgctaccttttgtttgcttttctgaacaagattagtcactttaaccatcccacattgttctccctgtaaagaatgactaagtaacctagtttccccccctaccattcagttggtgagcatacaaaaaaaagcgcgctcactaacgagtcgcgctggctgctattcagtaactaattgaattaatattatggcgcttagtcttattcgagtcccaaaatggcactttgaccacgcccaacaccttattggctgggacaaatccccagtaacgactatcatttgacactgaccgatgatcacctaacacaaagtacgaatgcttagggaccttagttgttttcagattccaactgtaacggttctccagcgtactcaaatcccaatttgtcgttccctgcgtccgctcatactgactgatgaacttctgcgggacaagcttgccattgacatagagtcggccgtcttcagatttaactgtatcaccgggcattccgatcactcgtttgacatatttgaccgtcttggagcgtgcgtctggatcaacttgataggcgttaaaaacgatgacactgaggtgctgaatcttagctgtcttgaccacggcgacgcgctcattgtcatctaagttaggttccattgacggtccatccacccgaaccatcgtaaaaataaagtgcctgatcaccatggcgacgagtaaccccactacaattggtagtacccagctcataatactcttaaaagttttcatcaaacgttctcccttaccccgctataacttccaatcattatagtccaatcaactcagcttgtctggtattggtgaatcgtttttacaaatttataagtaaccttgcaacgatatcacactaaaatgaccgccaaaacaatcttgacggtcattcataattttcttaatgactaactaacacatcttgatgacatctttcttccactcatcaagattgtggtgtatcttgcaaactccaattgacctttccatgataggatcctgcatacaattcgggctgaacatcgagaaaaataccttgtcgcgcttgccaggttgctgcaatattagtagtttgttgattaggatttgtatgtgtgccatggcctaccaacgtttcctgattggtcatcacatgtttttgaccagcagcatcaatatagaccaaatccccaattaatgagtgttgagcagacttcattttagttgcggtggcatacacataccactttgaagcaactggtcgcgtatcatgaacctcaatttgccactgatctgtgggcgataataatcgctcgctttgtggaatcgtgttactccgaaaacgcatttgagcattgatttgaccaaacatgagtcctgaatttacattaactgttaacgtatcaatattagatcgttggccgtgttgatctgacacccacactttcacatcattaggcccttgtttaagcgattcagtgggtaatttcagatgaaaataccccgccttatctggctcattcaccgaaccattggccttataactagcgatgggcgttccatcagcatgggcaaagtggatggttagtgcgttattttttaaaataacatcgcgatcaaaatcattctgatcagtccccaagatcattccggtcactaataccttgcgtcccttagaacgtgtttggatactttgacattcgatttgattttagttaaattagatcaaaaacaggagtttttaatccatgaaaagctttgcacaccattatagtagcgacatctctcgtgaacaatttgaactaatccggacagatctagaaggcatacgtaagcggactaagccaagaaaggttgatttatatgatatcttttgtgccctgctttataccttgaaaaatgggtgcgtttggcgcgatttacccagtgattttcctaaatgggaaaccgtctattattactggttactttggactaaaacgccatctcctgctggtatcactcatctggataaggttttaaaaaaattgtcagccaacatcggttggctcagaagcgttcagtttatacatcgttcatcattctagatgctcaaagtgtcaagaataccgatcctgctgaaagtagcggctacgatggtggtaaaaaggtgagtgggattaagcgccatcttgctgtagatatcaatgggctgccgatggcagtccatgtgacaaccgccaatgtttctgagcgtgatggcgccaatgcgctactggcgttaaacaaatcacagtttgacctggttcaacgagtaatggccgatggtggttatactggtaacaacttcgctcaatcagttcaggcaatgattaacgctgaagtcattattgctaaacagagtgaccttaggcacggtcaagtgaccccgcaacgctgggttatcgaacgcagttttagctggctaggaaaatatcggcgcctctggcgcaattgtgagcgaaagctgaacaccagtaagatgatgattagcttagccttcctgcgaatactcttgaaaagattctaaacacgttcttagcggttgaaaaggtatgaccattagttaaaaacaagttgagcttaatcgtcgcatccgttcgtggagttccgttattaatcaccgtttcagtgtgccctggaatatcatcatacgcatttgtttccgttaccatcaagtgaccattaccgctaaagcatttcatctgccagcgcccctcatgatcgactcgtgtttttttgatctgattaccaaatttagccgtgattagatcaccaccttgtgtgcccgtcccggtaatgatgcgcttattagcctcaaatccagtaatatgtggtgataatttaatctgactaaccatttgacagtactgcttcgttaccatgtaagcaggcagtgttcgaatgggattactgctcgcattagtactgctcttattaccaatccaaaccggctgacctgctttgattccatgcgtcttgatagtatctgttcgatgcggtcgccaaactcgattattgatattatacgccaggaaagttgcgccatactctttgccttggcgattcaaaaccagatcccataaattatataatcccttaccattcggcgaatgtactacacctttccctaaagtaattttcactcgactagtcttgtgcgtcatgtgaccatctcgcacataattagccgcaatgtgtgtaatgggccatggcactcgaccaattgttcgttgttcgaaattagttgtaatatcctgcatcgcactggtcggctcatcgacaacctttgcctgcccattaacagccatgaggcaaactaccaataacagcccacccacgaccaacgtgccagtaagtaaccttctcacttctacggtccctccttacctagcaatagctttctttattaaaccaacggataaccatcaataatatcagtagcacgctaccgaaactcgcataaaaccaggttaagagctgctcatcagtctgtggtaattgataatacccctttggtcttgtcaacgtcttttctgtcaccacacgatatggcctggtcccattaggaatcttaacgttgcgattatctatctgttgctgagttctctgaccagcataaaagctaacggtgactgttgaccgccccccaacggccgcaactcccgttattgttaacattattaaactgattaaaatggttgctacacacacgctaaaccgttgcaccatcctacccccattaattaacctaatccttcgaccgccgttgtcgccgccatagccagacgattacgcctaaccctaaccccagtactagcattgaaattgcgccaattccaattagcatccacatactaacccccttattatcaattgactcatgattatatttttgagctgctgtcatactaatatgaaaatctcgtttaaatcgccaatgatgacgctgattattaaccgtcatttgtaactgataatcacccggttgtaattgttgtgatcctaatggcattggtgctttaaaaactgtgtttggcgccatcatgacacccgttttcgtattcttaataatgaccttttgatgccgcttattaataatcactgttcggatttttaaattcggaatgattcttgcgacaggattacgtagcgcaacaataatgcttcgatgataattgttcaagccagctttcaccggccctagacacaaattaggaattggcaattttcctgaagataatttcaacccaataacatacgaatactcattcttaacgttgatacttttctccgttactcctgttaccttgtcatcaacccgtttaaaataccatccacccaacaagacgccatttactggctgcttaggtaacttcaccttgattgcgaccgttttggagccttcagccggaatcgttattgtccgctcaccctgaattgtggctaaatcactgactcggtattttaacgactgatcgtacgatttggccggattaatatattcaatcgtcccattagtattcgtatacgcggtatgaatagccgttcgaaccttaatatccttattagtgacattgtaaatgtctgtccgtaacgtctgctgttgaccgcttgccattttcaaatcaaaaaaagaattttgtttatgaatctgattttttggtatctcagcggcaacactaaaaccgacattgttgttgtggaccgattgttgccgattagccgacactcctgtctgtccgattaaaatactaaatccaagactcacacccattagtcttatgaattggataaccactttcaatctcaacacaccccatattatgacgcatcttttaaaactatcatttaataaaagggaagccactgctcgcgattacatcaacgattactttatccataataaccgttagccatcgccatctgctttagcttcccctcttggttatattctaactaacttgctggtgtatcactcaaactccagttcaaagttgtttggtacccctgcgctttagccgtgtttgccggcaccgttaacttaacattacttggatcaatttgatcaacagttacaccagcaccatgatctttcgctgccgataatactgtcgccgaattaccatctaacacgttaagagcctcagtggactgcacgccattattagttgcaccagaattagttaccgtaccttttggtagctgaagcgttgcccctttcattacagaaccgtctgtaccagtcaaactactcccggcaacggccagtgtccaaccagcattacttcctcggacatcagatacttctgtgactgcttttttgttccataaacctgataaatccgaatcagtttctgcggcagtgtacgtttctggatttaaaacatcgatctcatggcttccaaaatctaatttattagaaacgtagatcagcgataagccgccaccggctttagcaccgttaccactatcaccgctattatcaggcttattgggattatccggattaactggtgataccggactactattacctttaaacatcgcctgaatatcagtcgtaccagtcgtattggccgtactatctgcgttgggagcagcgggcgtatctgcctgagcgatgacacccgaactcactaataaactacttgccactaaaataccactgactaacttactaactcttaccaacaataactccccctttattttgtaaacactgtaaacaatgtttactagttctgaagtataagaccttaatttaatttagtcatcattaattaaagtgttgttgtttttttaatgaaacgtgtactaattaaaaagtaagctcactaaaaaagcacaattccaagttggaattgtgctttatcgttaaaaatattaattttttctttcatcattcgttaatatcaactgaacacaccagtcataccctactactgatgattattgaactttagcgattcgcccctgttgaatataaacactcagaattgcaatatccgcgggattaaccccactgatccgtgaagcttgtgcaatcgttgtcggctgaatcttctttagcttctgatgagcctcagtcgctaatccgtcgatcgcatcataatcgatccgatccggaatctttttagcttccatctttttcaaccgatcaacacgttcctctgctttttggatataaccggcatacttgatctgaatttcaacttgctcaataatatgccgttctagtggttcgggtgctgccgggataaatttcattaaatcagcatattgtacttctggccgctttaagaaatctgccgccaacacaccatccttaagctcaccagaattatgagcacgtaagaaagcattgacctcatcattaggtttgatcctgattttgcccaaacggtcaagttcattcttaattgcttggcgtttcgccttaaatgccgcataccgttcatcatcaatcaatcctaactcgcggcccttatccgttaaccgcaaatcagcattatcatgccgtaagattaaccggtattcagcccgactcgttagtaaccgatagggttcattggtgcccttagtaactaagtcatcaatcatgactccaatataagcatcactacgcttcaaagtgaattgaccacgatcaagggcacgcaaaccagcgttgataccggcaattaatccttgcccagcggcttcttcatacccagaagtcccattcgtttgaccagcagtatagagattcttgaccaactttgtttccaaggttgcctttaactggtaaggcgccaccacgtcgtattcgatggcataacctgggcgcatcatttcagcgtcttcaagacccttaatggaatgtaaaatccgctgttgaacttcttccggcatcgacgttgaaaggccctgaacataccattcatccgtattacggccttctggttccaagaataattggtgccgcttcttatcagcgaatcgcacgatcttatcttcgatcgatgggcagtaccgtggtccgaccccttcaatcacgcctgtaaacattggtgctcgatcaagattttcacgaatgatcttatgagtcgtctcattcgtataagttaaccagcaagataattgatgctttagatcaatgtagtcagcatccttcgtttcaaaactaaaatgatgtggttcaggatcaccaggttgttcttccgtaacactgtagtcgatcgtattaccatcgactcgtggtggtgtaccggtcttaaaccgttccaagttaaatccaagtcgttccagatcaccagataacttcatcgctggttgcgaattatttggacccgaagaatacattagttcaccaatgataatcttgccacgagccgccgtcccagtcgtcaaaacgacactcttggcactatagcgcgctcccgtattcgtgataacgcccttgcagaccccatcttcaacaattaagccatcgacaattccttgccgtaacgtcagattaggttcccgttcaatcgtgtgtttcatttccgcatggtaagcatgcttatcagcttgggcccgtaaagctcgaacagctgggcctttacccgtattaagcatccgcatctgaacgtaagtcttatcaatgttacggcccatttcaccgcccaaagcatcaatctcacggacgacaattcctttagccggaccaccaaccgatggattacatggcataaaggccaccatgtctaggttgatcgtcattaagagtgtccggttacccattcgggcagcggccaatgctgcttcagaaccggcatgaccagcaccaacgacgataacatcatagtcgcggcctgggtactgctttacttctgtcattccaatttcctcctaccactacttacccagacagaactgactaaatagctggtctaataattcatcttcatagctatccccggtaatttgaccgagaaattcccagcaacgggtcatatcgatttgaaccaaatcaactggcataccagccgcaagtcccgtttgaacatcttgcaacgcttgtttggcttgattcaacaaaccgatgtgacgcgcattggtcaccatcacgttattttgactactttcgataccttcattgaagaacatcttggcaatccgttgttcaagttgcgtgacgccactttgttccaagactgacatacttaaaacgtcactcaaatcgactaattgcgccaattcagcttgatcaagacgggctggtagatcagtcttgttcaagataacgattcgttttgactggtcagtctcttgcaacaactctcggtcttcagccgtcaacggttggctattatccaacactaataagactaaatcggcggccccgattgctttgcgacttcgctcgaccccaatcttttcgaccttatcttcagtgtcccgaattcctgccgtatcgacgagtttcaatggcactccacgaacattgacgtattcttcaatcacatcgcgggtcgtcccggcaacatccgtcacaatagctttgtcttcatgcaaaaggtggttaagcagactagatttaccgacattgggacgcccaatgatcgccgttgccaaaccttcgcgtaagaccttaccttgcttagccgtcgctaacagttgattaatgctttgggcgacctcggtagccttctccttcagcatcttggtggtcattgtttcaaccgcgtcatactctggataatcaatattgacctctacttgggctaacacgtccaaaatatcttgccgtaaatgtcgaatcagcttagatagatcaccatctaattggtttaacgcgaccttcatggacttatccgtcttagcacgaatcagatccataactgcttccgcctgtgacaagtccagccgaccattcaagaatgcccgcttggtaaattcaccgggttccgccattcgcgcaccgtgactcaagatcaattgtaaaatttcattagttgccacgagtcccccgtgacagttgatttcaactacgtcttcacgcgtataagttttaggcgcgcgcattacggtcgccatgacttcgtcgacttcctgatgggtatcaggatcaacaatatgtccatagttgattgtgtgtgattgcactcgactgagatctttacccttaaaaatctgggtcaccacgttaaacgtttggtccccactaatccgaataattgaaataccaccctcaccaggcggcgttgaaattgccgcgatcgtgtcaaattctgtggtcgttggcataccatcatgtcctttcttgtcagcgtttcatcgcctaataccataccaaatttacttacaattagttaataatatgtcctaaaatgcagaaaaaaagcgcctagtccacgccaccttaaagcgtggataaagcactttgactactttatctaaaagataagaatgattaacacctactataatagctcacccggagtttgtcaaacgcctgtttgcgttactttgaataaactatttgcgaatcgccacaaccacggcccggtgcggatcgcggccttctgagaatgtggttacatggtgattattcgctagttcagcgtgaattaatttccgttcaaacgatggcatcgggtccaagaaaacttgtttgcccgttgcaatcacttctcgagccgtactctcggctaaccgcttaagtgtcgcagcccggcgctcccgataatcatccacatctagcaccacgttaacgtgtgacgcgccatgatgattcatataaacttgcgccaaatcttgcagtgcattgatcgttcgaccgtgtttgccaatcagcaaaccctgcttagttgtatcgaaattcaatgtcgcatagcggttgccgaagtcgacgtcaagatccgccgtgacacctagttctttgaccaccgcaagcaagtaatcacacaacgcccgcaccgcggtctcgttagctgcttggcgcgctgcaatttctgcgggtgtccgcggcgtctggctctggtcagcagccactgatttggtcttactagtggtcgctggtttagattggtcggtatcagcgataaccgggccggtggtaaccgccattgaagcgggtttagccactgctttcgccttgctagtcgctggttttgcggcactggtcgtggcctgactagttttagcttgtctggtcggcgttgactttggtgtccgcacggtaggccgcggcatggtcggtgctgtcgttgattcagtagctactgactgttgcgctgtcgccgtagcggaagttggcgtcgttgcaggtgctgcggaggctggcaccaccgttagccgtacttgggcggggtgtttgcctagccccagaaatcctttttttgcttcagcgatcacttcaacttcaacttgatcgcgtgttcggtgcagttgttttagaccagccgcgattgcggccgcgacggtattaccttcaaatactgtcatgcttgaatcctcctcgttaaaaatcctgctttcattatagcattaccattcgccatgcgaacacctgagtatgaacacttaatgaacccttacaacgattaggacttcggccgttctactacccctgaaaactcagactagcaaaatctagtgcttattatgtcaataaccaacctgttcatggcgcgtttcagagacgcgccacaatattaaaaacatgtgatcaaacggtgcaagacaagcattattgtcagccgcttgattaccagcacctgatcgttcattacaatttcctcatcacggaccgtccagggccttacataaccgcacattaacattctgccatcacagcccaaatcatgttgaccgattggtaaaaatgatacaaagccaacaaaaaagacccaccacacatggcaggtctacttgtatttaacgtttatgattacgaatcgcgcgctttctagctttttcaagcgttcgcttacgatcacgttcagcttgcttcttagcttcccgttcgcgattaatcttgaatgggttttgtaataacaaggtttgaccaacttggaacgcgttggaaatcacccagtacaaggacaacgctgatggcacgttaatggccgtaatcaaaataatcacaggcatcaaatacgtcattgacgttgtcatcccgttttgttctggctgcgacttcatcgctaaccaggaactagcaaacgtaaagatcgccgctagaattggcaaaacgtagtacggatccttgctacctaattgcaaccataagaacgaaccggtcttcaaggcttgtgtccgccagattgcttggtacaacgcaatcaaaataggcaactgaactagtaatggcaacatgctggccattggatgcacaccatgcttggcatacaacttcttcatttccgcttggagcttttgctgagtttccatatcgcgtgacgaatacttcttttgcaaagccttcatctgcggttggacttcttgcatggctaccatgttgcgggtttggaagatcatcaatggcaagataatgatccggatgatcaacgtaaagacgatgatcccgagaccataactatgaccaaacaagtttgataaccaaataatcgcccgtgagaagttcaagatgattaagccatcccaaaacccggtgctcttatccgtgattggggtattactacacccactcaaaactagtacgatcgctagtacggccagcattgccagtatttttctgtactttttcaaacgaatgtcctcactttaatcattgtccagcaggtgcgctagctttagcgcatggcttagataagctttggtttcggcttgcgacttaccagcaacggttggtcgggcaatgacgagaaagtctgcatcttgcttaagctgcggctttagctcggtgattgattgccgaatccggcgtttgacccagttacgcgcaacggcgttcccgatcttcttaccgaccgaaataccgacgcggaaatggggttgccccggtttttccaaaacgtaaatgacaaattgacgattggcatacgagttgcgggtctcaaaaacttgttggaactcagtttctttttttacccgatatgattttcgcataatccatctccatgtgtgcgctcaagctcttgagcgaattgctacacaactttacagccctaaacacctggtctaggactgtaaagaaaaagccactgattatcagtggcctatgcagacaatacttttctgcctcgttggcgtcgacgggctaacactttacggccattgctggtgctcatccgtttgcggaaaccatgtacacgttgacgatggcgcttctttggttggtaagttctcttcatcatgacacctccttctccataatgacatgaatcaattcgattaagtcgttattttcaaaacgcagtttacatctaaacgcatttcctgactactatagcatatttttatttgtttgaaaaccagtaaattaaatttctccgtagtaattcgaggtcaaaaaattatttaattgcgaatttatttgtggattatagcaaagtgactttccgttattcgcaatttacccacaagtttttcgacaaagtaacgggttgttatttagttatccacagggcgtatttgttgtgtgtataactccaataaacgcttttattgcggctttagttttaaactcgcttttgtggataagtgttgttttataaaattcattcctagttttcgacaagctgtgtatattcaaatcccagcctgtgaattctcttgactttaacttgtccacttgtggaaaactctatatgttcatgctaaaatagaattacgttttttaagaaaaggggtatccacgtg
